US010273519B2

(12) United States Patent
Broers et al.

(10) Patent No.: US 10,273,519 B2
(45) Date of Patent: Apr. 30, 2019

(54) DITERPENE PRODUCTION IN YARROWIA

(71) Applicant: DSM IP ASSETS B.V., Heerlen (NL)

(72) Inventors: Nicolette Jasmijn Broers, Echt (NL); Viktor Marius Boer, Echt (NL); Adam G. Lawrence, Lexington, MA (US)

(73) Assignee: DSM IP ASSETS B.V., Heerlen (NL)

( * ) Notice: Subject to any disclaimer, the term of this patent is extended or adjusted under 35 U.S.C. 154(b) by 196 days.

(21) Appl. No.: 14/906,497

(22) PCT Filed: Jul. 23, 2014

(86) PCT No.: PCT/EP2014/065858
§ 371 (c)(1),
(2) Date: Jan. 20, 2016

(87) PCT Pub. No.: WO2015/011209
PCT Pub. Date: Jan. 29, 2015

(65) Prior Publication Data
US 2016/0160257 A1 Jun. 9, 2016

Related U.S. Application Data

(63) Continuation of application No. 13/949,079, filed on Jul. 23, 2013, now abandoned.

(51) Int. Cl.
*C12P 19/56* (2006.01)
*A23L 2/60* (2006.01)
*C12N 9/00* (2006.01)
*C12N 15/52* (2006.01)
*C12N 9/88* (2006.01)
*C12N 9/90* (2006.01)
*C12N 15/00* (2006.01)
*C07C 62/32* (2006.01)
*C07H 15/256* (2006.01)
*C12N 9/02* (2006.01)
*C12N 9/10* (2006.01)
*C12P 15/00* (2006.01)
*A23L 27/30* (2016.01)

(52) U.S. Cl.
CPC .............. *C12P 19/56* (2013.01); *A23L 2/60* (2013.01); *A23L 27/36* (2016.08); *C07C 62/32* (2013.01); *C07H 15/256* (2013.01); *C12N 9/0042* (2013.01); *C12N 9/0073* (2013.01); *C12N 9/0083* (2013.01); *C12N 9/1051* (2013.01); *C12N 9/88* (2013.01); *C12N 9/90* (2013.01); *C12N 15/52* (2013.01); *C12P 15/00* (2013.01); *C07C 2603/86* (2017.05); *C12Y 114/13078* (2013.01); *C12Y 114/13079* (2013.01); *C12Y 402/03019* (2013.01); *C12Y 505/01013* (2013.01)

(58) Field of Classification Search
None
See application file for complete search history.

(56) References Cited

U.S. PATENT DOCUMENTS

2012/0164678 A1* 6/2012 Stephanopoulos ...... A01H 5/00
435/29

FOREIGN PATENT DOCUMENTS

| WO | 2011153378 A1 | 12/2011 |
| WO | 2013022989 A2 | 2/2013 |
| WO | 2013110673 A1 | 8/2013 |
| WO | 2014/191580 A1 | 4/2014 |
| WO | 2014/191581 A2 | 4/2014 |
| WO | 2015/007748 A1 | 1/2015 |

OTHER PUBLICATIONS

Coelho MAZ, Amaral PFF, Belo I. Currient Research, Technology and Education Topics in Applied Microbiology and Microbial Biotechnology. 2010. lipolytica: an industrial workhorse; pp. 930-944.*
Kebabci et al., "Comparison of three Yarrowia lipolytica strains for lipase production: NBRC 1658, IFO 1195, and a local strain", Turk J Biol., 2012, 36: 15-24. doi:10.3906/biy-1102-10.*
International Search Report from corresponding PCT/EP2014/065858, dated Oct. 20, 2014.
Moeller et al., "Optimization of Citric Acid Production from Glucose" Engineering in Life Sciences. (Oct. 2007) vol. 7, No. 5: 504-511.
Kumar et al., "A comprehensive analysis of fifteen genes of steviol glycosides biosynthesis pathway in Stevia rebaudiana (Bertoni)" Gene. (Oct. 2011) vol. 492, No. 1:276-284.
Brandle et al., "Steviol glycoside biosynthesis" Phytochemistry. (Jul. 1, 2007) vol. 68, No. 14: 1855-1863.
Goncalves et al., "Parrowia lipolytica and its multiple applications in the Biotechnological Industry" The Scientific World Journal. (Mar. 13, 2014) vol. 33, No. 4: 1-15.

* cited by examiner

*Primary Examiner* — Suzanne M Noakes
(74) *Attorney, Agent, or Firm* — McBee Moore Woodward & Vanik IP, LLC; Susan McBee; Chester Moore

(57) ABSTRACT

The present invention relates to a method for the production of a diterpene or a glycosylated diterpene, which method comprises: a. fermenting a recombinant microorganism of the genus *Yarrowia* in a suitable fermentation medium at a temperature of about 29° C. or higher, wherein the microorganism comprises one or more nucleotide sequence(s) encoding: a polypeptide having ent-copalyl pyrophosphate synthase activity; a polypeptide having ent-Kaurene synthase activity; a polypeptide having ent-Kaurene oxidase activity; and a polypeptide having kaurenoic acid 13-hydroxylase activity and whereby expression of the nucleotide sequence(s) confer(s) on the microorganism the ability to produce at least steviol; and b. recovering the diterpene or glycosylated diterpene.

23 Claims, 5 Drawing Sheets
Specification includes a Sequence Listing.

DITERPENE PRODUCTION IN YARROWIA

CROSS REFERENCE TO RELATED APPLICATIONS

This application is a § 371 National Stage Application of PCT/EP2014/065858, filed 23 Jul. 2014 which claims priority to U.S. Ser. No. 13/949,079, filed 23 Jul. 2013.

BACKGROUND

Field of the Invention

The present invention relates to a process for the production of a diterpene and/or a glycosylated diterpene using a recombinant microorganism of the genus *Yarrowia*. The invention further relates to a fermentation broth comprising a diterpene and/or glycosylated diterpene obtainable by such a process.

Background to the Invention

The worldwide demand for high potency sweeteners is increasing and, with blending of different artificial sweeteners, becoming a standard practice. However, the demand for alternatives is expected to increase. The leaves of the perennial herb, *Stevia rebaudiana* Bert., accumulate quantities of intensely sweet compounds known as steviol glycosides. Whilst the biological function of these compounds is unclear, they have commercial significance as alternative high potency sweeteners, with the added advantage that *Stevia* sweeteners are natural plant products.

These sweet steviol glycosides have functional and sensory properties that appear to be superior to those of many high intensity sweeteners. In addition, studies suggest that stevioside can reduce blood glucose levels in Type II diabetics and can reduce blood pressure in mildly hypertensive patients.

Steviol glycosides accumulate in *Stevia* leaves where they may comprise from 5 to 20% of the leaf dry weight. Stevioside and rebaudioside A are both heat and pH stable and suitable for use in beverages and many other foods. Stevioside is between 110 and 270 times sweeter than sucrose, rebaudioside A between 150 and 320 times sweeter than sucrose. In addition, rebaudioside D with a better taste profile is also a high-potency diterpene glycoside sweetener which accumulates in *Stevia* leaves. It may be about 200 times sweeter than sucrose Currently, steviol glycosides are extracted from the *Stevia* plant. In *Stevia*, (−)-kaurenoic acid, an intermediate in gibberellic acid (GA) biosynthesis, is converted into the tetracyclic dipterepene steviol, which then proceeds through a multi-step glucosylation pathway to form the various steviol glycosides. However, yields may be variable and affected by agriculture and environmental conditions. Also, *Stevia* cultivation requires substantial land area, a long time prior to harvest, intensive labour and additional costs for the extraction and purification of the glycosides.

New, more standardized, clean single composition, no after-taste, sources of glycosides are required to meet growing commercial demand for high potency, natural sweeteners.

SUMMARY OF THE INVENTION

In *Stevia*, steviol is synthesized from GGPP, which is formed by the deoxyxylulose 5-phosphate pathway. The activity of two diterpene cyclases (−)-copalyl diphosphate synthase (CPS) and (−)-kaurene synthase (KS) results in the formation of (−)-Kaurene which is then oxidized in a three step reaction by (−)-kaurene oxidase (KO) to form (−)-kaurenoic acid.

In *Stevia* leaves, (−)-kaurenoic acid is then hydroxylated, by ent-kaurenoic acid 13-hydroxylase (KAH) to form steviol. Steviol is then glucosylated by a series of UDP-glucosyltransferases (UGTs).

This invention relates to a process for the production of a diterpene or a glycosylated diterpene using a microorganism which is capable of producing a diterpene, such as steviol, or a glycosylated diterpene (i.e. a diterpene glycoside), such as steviolmonoside, steviolbioside, stevioside, rebaudioside A, rebaudioside B, rebaudioside C, rebaudioside D, rebaudioside E, rebaudioside F, rebaudioside M. rubusoside or dulcoside A. The microorganism is of the genus *Yarrowia*.

According to the invention, there is thus provided method for the production of a diterpene or a glycosylated diterpene, which method comprises:

a. fermenting a recombinant microorganism of the genus *Yarrowia* in a suitable fermentation medium at a temperature of about 29° C. or higher,
wherein the microorganism comprises one or more nucleotide sequence(s) encoding: a polypeptide having ent-copalyl pyrophosphate synthase activity: a polypeptide having ent-Kaurene synthase activity; a polypeptide having ent-Kaurene oxidase activity; and a polypeptide having kaurenoic acid 13-hydroxylase activity and whereby expression of the nucleotide sequence(s) confer(s) on the microorganism the ability to produce at least steviol; and
b. recovering the diterpene or glycosylated diterpene.

That is to say, the process of the invention is a process for production of a diterpene or a glycosylated diterpene in the genus *Yarrowia* wherein the fermentation is carried out at a temperature higher than that of a typical fermentation for that genus. A diterpene or a glycosylated diterpene is produced by the host microorganism of the genus *Yarrowia* and then physically and/or chemically recovered from the microorganism and/orfermentation medium.

In a process of the invention, the recombinant microorganism of the genus *Yarrowia* may comprise one or more nucleotide sequence(s) encoding one or more polypeptides having UDP-glucosyltransferase activity (UGT),
whereby expression of the nucleotide sequence confers on the microorganism the ability to produce at least one of steviolmonoside, steviolbioside, stevioside, rebaudioside A, rebaudioside B, rebaudioside C, rebaudioside D, rebaudioside E, rebaudioside F, rebaudioside M, rubusoside or dulcoside A.

According to the invention, there is also provided:
a fermentation broth comprising a diterpene or glycosylated diterpene obtainable by the process of the invention;
a diterpene or glycosylated diterpene obtained by a process of the invention or obtainable from a fermentation broth of the invention;
a foodstuff, feed or beverage which comprises a diterpene or glycosylated diterpene of the invention; and
use of a recombinant microorganism of the genus *Yarrowia* in the fermentative production of a diterpene or glycosylated diterpene at a temperature of about 29° C. or higher.

DESCRIPTION OF THE SEQUENCE LISTING

Figure 1:
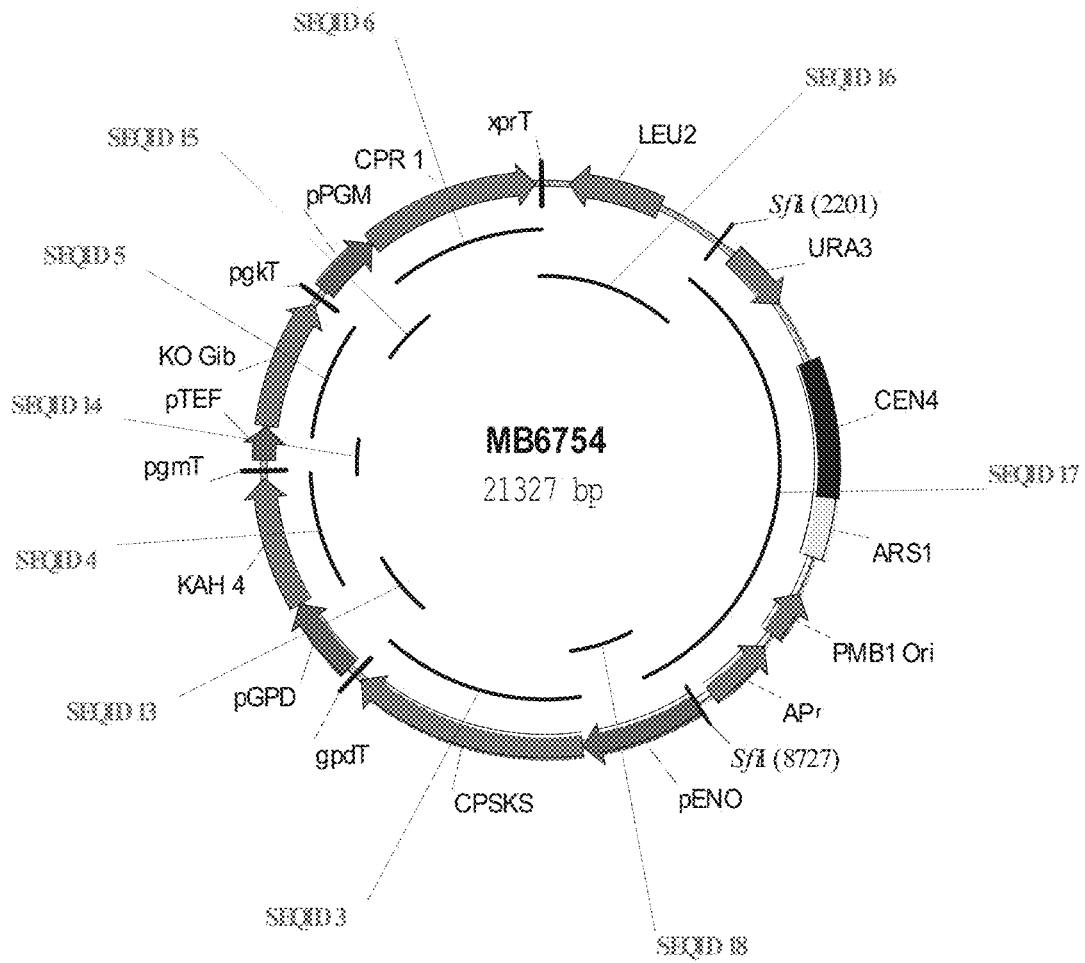
FIG. 1 sets out a schematic representation of the plasmid MB6754.

A description of the sequences is set out in Table 1. Sequences described herein may be defined with reference to the sequence listing or with reference to the database accession numbers also set out in Table 1.

DETAILED DESCRIPTION OF THE INVENTION

Throughout the present specification and the accompanying claims, the words "comprise", "include" and "having" and variations such as "comprises", "comprising", "includes" and "including" are to be interpreted inclusively. That is, these words are intended to convey the possible inclusion of other elements or integers not specifically recited, where the context allows.

The articles "a" and "an" are used herein to refer to one or to more than one (i.e. to one or at least one) of the grammatical object of the article. By way of example, "an element" may mean one element or more than one element.

We have shown that a recombinant microorganism of the genus *Yarrowia* as described herein is capable of producing a diterpene or glycosylated diterpene and preferentially does so at a temperature of about 29° C. or higher.

Accordingly, the invention relates to a process for the production of a diterpene or a glycosylated diterpene which method comprises the use of a recombinant microorganism of the genus *Yarrowia*.

The process of the invention is typically a fermentation process in which the recombinant microorganism produces a diterpene or glycosylated. This, diterpene or glycosylated diterpene may be recovered from the microorganism and/or fermentation broth. The recombinant microorganism of the genus *Yarrowia* used in the process is one that is capable of producing a diterpene or a glycosylated diterpene, typically steviol or a steviol glycoside respectively.

For the purposes of this invention, a diterpene typically means an organic compound composed of four isoprene units. Such a compound may be derived from geranylgeranyl pyrophosphate. A glycosylated diterpene or diterpene glycoside is a diterpene in which a sugar is bound, typically to a non-carbohydrate moiety. Typically, in a diterpene glycoside, the sugar group may be bonded through its anomeric carbon to another group via a glycosidic bond. A preferred diterpene and diterpene glycoside is steviol and steviol glycoside respectively. Thus, in particular, the invention relates to a recombinant microorganism which is capable of producing steviol or a steviol glycoside.

Herein glycosylation and glucosylation should be taken to mean the same thing.

According to the invention, there is provided a method for the production of a diterpene or a glycosylated diterpene, which method comprises:

a. fermenting a recombinant microorganism of the genus *Yarrowia* in a suitable fermentation medium at a temperature of 29° C. or higher, wherein the microorganism comprises one or more nucleotide sequence(s) encoding:

a polypeptide having ent-copalyl pyrophosphate synthase activity;

a polypeptide having ent-Kaurene synthase activity;

a polypeptide having ent-Kaurene oxidase activity; and a polypeptide having kaurenoic acid 13-hydroxylase activity and whereby expression of the nucleotide sequence(s) confer(s) on the microorganism the ability to produce at least steviol; and b. recovering the diterpene or glycosylated diterpene.

The recombinant microorganism used in the invention may be one of the genus *Yarrowia*, for example *Yarrowia lipolytica*.

The recombinant microorganism of the genus *Yarrowia* used in the invention comprises one or more nucleotide sequence(s) encoding:

a polypeptide having ent-copalyl pyrophosphate synthase activity;

a polypeptide having ent-Kaurene synthase activity;

a polypeptide having ent-Kaurene oxidase activity; and a polypeptide having kaurenoic acid 13-hydroxylase activity, whereby expression of the nucleotide sequence(s) confer(s) on the microorganism the ability to produce at least steviol For the purposes of this invention, a polypeptide having ent-copalyl pyrophosphate synthase (EC 5.5.1.13) is capable of catalyzing the chemical reaction:

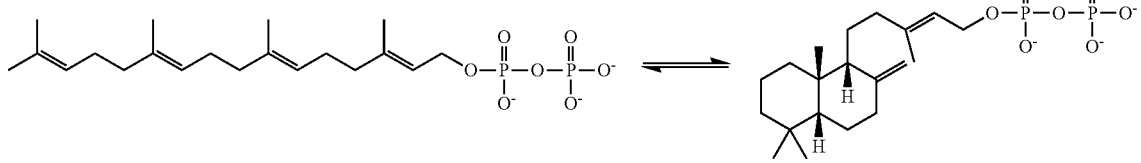

This enzyme has one substrate, geranylgeranyl pyrophosphate, and one product, ent-copalyl pyrophosphate. This enzyme participates in gibberellin biosynthesis. This enzyme belongs to the family of isomerase, specifically the class of intramolecular lyases. The systematic name of this enzyme class is ent-copalyl-diphosphate lyase (decyclizing). Other names in common use include having ent-copalyl pyrophosphate synthase, ent-kaurene synthase A, and ent-kaurene synthetase A.

For the purposes of this invention, a polypeptide having ent-kaurene synthase activity (EC 4.2.3.19) is a polypeptide that is capable of catalyzing the chemical reaction:

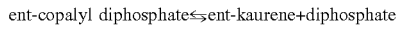

Hence, this enzyme has one substrate, ent-copalyl diphosphate, and two products, ent-kaurene and diphosphate.

This enzyme belongs to the family of lyases, specifically those carbon-oxygen lyases acting on phosphates. The systematic name of this enzyme class is ent-copalyl-diphosphate diphosphate-lyase (cyclizing, ent-kaurene-forming). Other names in common use include ent-kaurene synthase B, ent-kaurene synthetase B, ent-copalyl-diphosphate diphosphate-lyase, and (cyclizing). This enzyme participates in diterpenoid biosynthesis.

ent-copalyl diphosphate synthases may also have a distinct ent-kaurene synthase activity associated with the same protein molecule. The reaction catalyzed by ent-kaurene synthase is the next step in the biosynthetic pathway to gibberellins. The two types of enzymatic activity are distinct, and site-directed mutagenesis to suppress the ent-kaurene synthase activity of the protein leads to build up of ent-copalyl pyrophosphate.

Accordingly, a single nucleotide sequence used in the invention may encode a polypeptide having ent-copalyl pyrophosphate synthase activity and ent-kaurene synthase activity. Alternatively, the two activities may be encoded two distinct, separate nucleotide sequences.

For the purposes of this invention, a polypeptide having ent-kaurene oxidase activity (EC 1.14.13.78) is a polypeptide which is capable of catalysing three successive oxidations of the 4-methyl group of ent-kaurene to give kaurenoic acid. Such activity typically requires the presence of a cytochrome P450.

For the purposes of the invention, a polypeptide having kaurenoic acid 13-hydroxylase activity (EC 1.14.13) is one which is capable of catalyzing the formation of steviol (ent-kaur-16-en-13-ol-19-oic acid) using NADPH and $O_2$. Such activity may also be referred to as ent-ka 13-hydroxylase activity.

A recombinant microorganism for use in the method of the invention may comprise one or more nucleotide sequences encoding a polypeptide having UDP-glucosyltransferase (UGT) activity, whereby expression of the nucleotide sequence(s) confer(s) on the microorganism the ability to produce at least one of steviolmonoside, steviolbioside, stevioside or rebaudioside A, rebaudioside B, rebaudioside C, rebaudioside D, rebaudioside E, rebaudioside F, rebaudioside M, rubusoside, dulcoside A.

For the purposes of this invention, a polypeptide having UGT activity is one which has glycosyltransferase activity (EC 2.4), i.e. that can act as a catalyst for the transfer of a monosaccharide unit from an activated nucleotide sugar (also known as the "glycosyl donor") to a glycosyl acceptor molecule, usually an alcohol. The glycosyl donor for a UGT is typically the nucleotide sugar uridine diphosphate glucose (uracil-diphosphate glucose, UDP-glucose).

Figure 5:
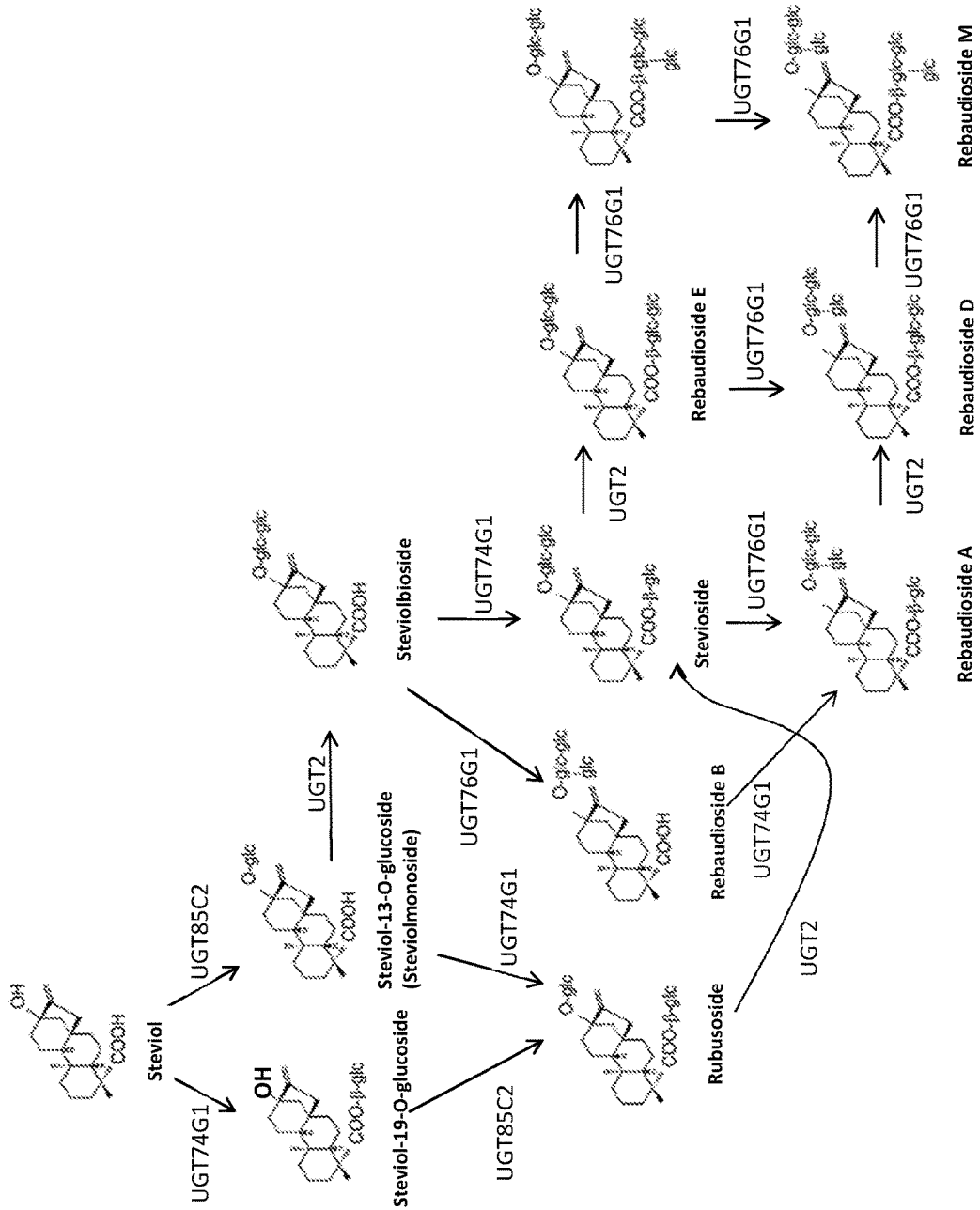
FIG. 5 sets out a schematic diagram of the potential pathways leading to biosynthesis of steviol glycosides.

The UGTs used may be selected so as to produce a desired diterpene glycoside, such as a steviol glycoside. Schematic diagrams of steviol glycoside formation are set out in Humphrey et al., Plant Molecular Biology (2006) 61: 47-62 and Mohamed et al., J. Plant Physiology 168 (2011) 1136-1141. In addition, FIG. 5 sets out a schematic diagram of steviol glycoside formation.

The biosynthesis of rebaudioside A involves glucosylation of the aglycone steviol. Specifically, rebaudioside A can be formed by glucosylation of the 13-OH of steviol which forms the 13-O-steviolmonoside, glucosylation of the C-2' of the 13-O-glucose of steviolmonoside which forms steviol-1,2-bioside, glucosylation of the C-19 carboxyl of steviol-1,2-bioside which forms stevioside, and glucosylation of the C-3' of the C-13-O-glucose of stevioside. The order in which each glucosylation reaction occurs can vary—see FIG. 5. One UGT may be capable of catalyzing more than one conversion as set out in this scheme.

Conversion of steviol to rebaudioside A or rebaudioside D may be accomplished in a recombinant host by the expression of gene(s) encoding the following functional UGTs: UGT74G1, UGT85C2, UGT76G1 and UGT2. Thus, a recombinant microorganism for use in the method of the invention which expresses these four UGTs can make rebaudioside A if it produces steviol or when fed steviol in the medium. Typically, one or more of these genes are recombinant genes that have been transformed into a microorganism that does not naturally possess them. Examples of all of these enzymes are set out in Table 1. A microorganism of the invention may comprise any combination of a UGT74G1, UGT85C2, UGT76G1 and UGT2. In Table 1 UGT64G1 sequences are indicated as UGT1 sequences, UGT74G1 sequences are indicated as UGT3 sequences and UGT76G1 sequences are indicated as UGT4 sequences. UGT2 sequences are indicated as UGT2 sequences in Table 1.

We have shown that conversion of steviol to rebaudioside M may be accomplished in a recombinant host by the expression of gene(s) encoding the following functional UGTs: UGT74G1, UGT85C2, UGT76G1 and UGT2.

Thus, a recombinant microorganism expressing these four UGTs can make rebaudioside M if it produces steviol or when fed steviol in the medium. Typically, one or more of these genes are recombinant genes that have been transformed into a microorganism that does not naturally possess them.

A recombinant microorganism suitable for use in the invention which comprises a nucleotide sequence encoding a polypeptide having UGT activity may comprise a nucleotide sequence encoding a polypeptide capable of catalyzing the addition of a C-13-glucose to steviol. That is to say, a microorganism suitable for use in a method of the invention may comprise a UGT which is capable of catalyzing a reaction in which steviol is converted to steviolmonoside. Accordingly, expression of such a nucleotide sequence may confer on the microorganism the ability to produce at least steviolmonoside.

Such a microorganism may comprise a nucleotide sequence encoding a polypeptide having the activity shown by UDP-glycosyltransferase (UGT) UGT85C2, whereby the nucleotide sequence upon transformation of the microorganism confers on the cell the ability to convert steviol to steviolmonoside.

UGT85C2 activity is transfer of a glucose unit to the 13-OH of steviol. Thus, a suitable UGT85C2 may function as a uridine 5'-diphospho glucosyl: steviol 13-OH transferase, and a uridine 5'-diphospho glucosyl: steviol-19-0-glucoside 13-OH transferase. A functional UGT85C2 polypeptide may also catalyze glucosyl transferase reactions that utilize steviol glycoside substrates other than steviol and steviol-19-O-glucoside. Such sequences are indicated as UGT1 sequences in Table 1.

A recombinant microorganism for use in a method of the invention which comprises a nucleotide sequence encoding a polypeptide having UGT activity may comprise a nucleotide sequence encoding a polypeptide capable of catalyzing the addition of a C-13-glucose to steviol or steviolmonoside. That is to say, a suitable microorganism may comprise a UGT which is capable of catalyzing a reaction in which steviolmonoside is converted to steviolbioside. Accordingly, such a microorganism may be capable of converting steviolmonoside to steviolbioside. Expression of such a nucleotide sequence may confer on the microorganism the ability to produce at least steviolbioside.

A microorganism suitable for use in a method of the invention may also comprise a nucleotide sequence encoding a polypeptide having the activity shown by UDP-glycosyltransferase (UGT) UGT74G1, whereby the nucleotide sequence upon transformation of the microorganism confers on the cell the ability to convert steviolmonoside to steviolbioside.

A microorganism suitable for use in a method of the invention may also comprise a nucleotide sequence encoding a polypeptide having the activity shown by UDP-glycosyltransferase (UGT) UGT2, whereby the nucleotide sequence upon transformation of the microorganism confers on the cell the ability to convert steviolmonoside to steviolbioside.

A suitable UGT2 polypeptide functions as a uridine 5'-diphospho glucosyl: steviol-13-O-glucoside transferase (also referred to as a steviol-13-monoglucoside 1,2-glucosylase), transferring a glucose moiety to the C-2' of the 13-O-glucose of the acceptor molecule, steviol-13-O-glucoside. Typically, a suitable UGT2 polypeptide also functions as a uridine 5'-diphospho glucosyl: rubusoside transferase transferring a glucose moiety to the C-2' of the 13-O-glucose of the acceptor molecule, rubusoside.

Functional UGT2 polypeptides may also catalyze reactions that utilize steviol glycoside substrates other than steviol-13-0-glucoside and rubusoside, e.g., functional UGT2 polypeptides may utilize stevioside as a substrate, transferring a glucose moiety to the C-2' of the 19-O-glucose residue to produce Rebaudioside E. A functional UGT2 polypeptides may also utilize Rebaudioside A as a substrate, transferring a glucose moiety to the C-2' of the 19-O-glucose residue to produce Rebaudioside D. However, a functional UGT2 polypeptide typically does not transfer a glucose moiety to steviol compounds having a 1,3-bound glucose at the C-13 position, i.e., transfer of a glucose moiety to steviol 1,3-bioside and 1,3-stevioside does not occur.

Functional UGT2 polypeptides may also transfer sugar moieties from donors other than uridine diphosphate glucose. For example, a functional UGT2 polypeptide may act as a uridine 5'-diphospho D-xylosyl: steviol-13-O-glucoside transferase, transferring a xylose moiety to the C-2' of the 13-O-glucose of the acceptor molecule, steviol-13-O-glucoside. As another example, a functional UGT2 polypeptide can act as a uridine 5'-diphospho L-rhamnosyl: steviol-13-0-glucoside transferase, transferring a rhamnose moiety to the 0-2' of the 13-O-glucose of the acceptor molecule, steviol-13-O-glucoside. Such sequences are indicated as UGT2 sequences in Table 1.

A recombinant microorganism suitable for use in a method of the invention which comprises a nucleotide sequence encoding a polypeptide having UGT activity may comprise a nucleotide sequence encoding a polypeptide capable of catalyzing the addition of a C-19-glucose to steviolbioside. That is to say, such a microorganism may comprise a UGT which is capable of catalyzing a reaction in which steviolbioside is converted to stevioside. Accordingly, such a microorganism may be capable of converting steviolbioside to stevioside. Expression of such a nucleotide sequence may confer on the microorganism the ability to produce at least stevioside.

A microorganism suitable for use in a method of the invention may also comprise a nucleotide sequence encoding a polypeptide having the activity shown by UDP-glycosyltransferase (UGT) UGT74G1, whereby the nucleotide sequence upon transformation of the microorganism confers on the cell the ability to convert steviolbioside to stevioside.

Suitable UGT74G1 polypeptides may be capable of transferring a glucose unit to the 13-OH or the 19-COOH, respectively, of steviol. A suitable UGT74G1 polypeptide may function as a uridine 5'-diphospho glucosyl: steviol 19-COOH transferase and a uridine 5'-diphospho glucosyl: steviol-13-O-glucoside 19-COOH transferase. Functional UGT74G1 polypeptides also may catalyze glycosyl transferase reactions that utilize steviol glycoside substrates other than steviol and steviol-13-O-glucoside, or that transfer sugar moieties from donors other than uridine diphosphate glucose. Such sequences are indicated as UGT1 sequences in Table 1.

A recombinant microorganism suitable for use in a method of the invention which comprises a nucleotide sequence encoding a polypeptide having UGT activity may comprise a nucleotide sequence encoding a polypeptide capable of catalyzing glucosylation of the C-3' of the glucose at the C-13 position of steviside. That is to say, such a microorganism may comprise a UGT which is capable of catalyzing a reaction in which stevioside to rebaudioside A. Accordingly, such a microorganism may be capable of converting stevioside to rebaudioside A. Expression of such a nucleotide sequence may confer on the microorganism the ability to produce at least rebaudioside A.

A microorganism suitable for use in a method of the invention may also comprise a nucleotide sequence encoding a polypeptide having the activity shown by UDP-glycosyltransferase (UGT) UGT76G1, whereby the nucleotide sequence upon transformation of the microorganism confers on the cell the ability to convert stevioside to rebaudioside A and/or the ability to convert rebaudioside D to rebaudioside M.

A suitable UGT76G1 adds a glucose moiety to the C-3' of the C-13-O-glucose of the acceptor molecule, a steviol 1,2 glycoside. Thus, UGT76G1 functions, for example, as a uridine 5'-diphospho glucosyl: steviol 13-0-1,2 glucoside 0-3' glucosyl transferase and a uridine 5'-diphospho glucosyl: steviol-19-0-glucose, 13-0-1,2 bioside C-3' glucosyl transferase. Functional UGT76G1 polypeptides may also catalyze glucosyl transferase reactions that utilize steviol glycoside substrates that contain sugars other than glucose, e.g., steviol rhamnosides and steviol xylosides. Such sequences are indicated as UGT4 sequences in Table 1.

A microorganism suitable for use in a method of the invention may comprise nucleotide sequences encoding polypeptides having one or more of the four UGT activities described above. Preferably, a microorganism of the invention may comprise nucleotide sequences encoding polypeptides having all four of the UGT activities described above. A given nucleic acid may encode a polypeptide having one or more of the above activities. For example, a nucleic acid encode for a polypeptide which has two, three or four of the activities set out above. Preferably, such a recombinant microorganism of the invention comprises UGT1, UGT2 and UGT3 activity. More preferably, such a recombinant microorganism will also comprise UGT4 activity.

A microorganism suitable for use in a method of the invention which comprises a nucleotide sequence encoding a polypeptide having UGT activity may comprise a nucleotide sequence encoding a polypeptide capable of catalyzing the glucosylation of stevioside or rebaudioside A. That is to say, such a microorganism may comprise a UGT which is capable of catalyzing a reaction in which stevioside or rebaudioside A is converted to rebaudioside D. Accordingly, such a microorganism may be capable of converting stevioside or rebaudioside A to rebaudioside D. Expression of such a nucleotide sequence may confer on the microorganism the ability to produce at least rebaudioside D. Such a microorganism may be capable of further converting rebaudioside D to rebaudioside M.

A microorganism suitable for use in a method of the invention may comprises nucleotide sequences so that the microorganism is capable of expression a combination of UGT85C2, UGT2, UGT74G1 and UGT76G1 polypeptides and thus capable of rebaudioside M production.

A microorganism suitable for use in a method of the invention which comprises a nucleotide sequence encoding a polypeptide having UGT activity may comprise a nucleotide sequence encoding a polypeptide capable of catalyzing the glucosylation of stevioside. That is to say, such a microorganism may comprise a UGT which is capable of catalyzing a reaction in which stevioside is converted to rebaudioside E. Accordingly, such a microorganism may be capable of converting stevioside to rebaudioside E. Expression of such a nucleotide sequence may confer on the microorganism the ability to produce at least rebaudioside E.

A microorganism suitable for use in a method of the invention which comprises a nucleotide sequence encoding a polypeptide having UGT activity may comprise a nucleotide sequence encoding a polypeptide capable of catalyzing the glucosylation of rebaudioside E. That is to say, such a microorganism may comprise a UGT which is capable of catalyzing a reaction in which rebaudioside E is converted to rebaudioside D. Accordingly, such a microorganism may be capable of converting stevioside or rebaudioside A to rebaudioside D. Expression of such a nucleotide sequence may confer on the microorganism the ability to produce at least rebaudioside D. Such a microorganism may be capable of further converting rebaudioside D to rebaudioside M.

A recombinant microorganism suitable for use in a method of the invention may be capable of expressing a nucleotide sequence encoding a polypeptide having NADPH-cytochrome p450 reductase activity. That is to say, such a recombinant microorganism may comprise sequence encoding a polypeptide having NADPH-cytochrome p450 reductase activity.

For the purposes of the invention, a polypeptide having NADPH-Cytochrome P450 reductase activity (EC 1.6.2.4; also known as NADPH:ferrihemoprotein oxidoreductase, NADPH:hemoprotein oxidoreductase, NADPH:P450 oxidoreductase, P450 reductase, POR, CPR, CYPOR) is typically one which is a membrane-bound enzyme allowing electron transfer to cytochrome P450 in the microsome of the eukaryotic cell from a FAD- and FMN-containing enzyme NADPH:cytochrome P450 reductase (POR; EC 1.6.2.4).

Preferably, a recombinant microorganism suitable for use in a method according to any one of the preceding claims, which is capable of expressing one or more of:
 a. a nucleotide sequence encoding a polypeptide having NADPH-cytochrome p450 reductase activity, wherein said nucleotide sequence comprises:
  i. a nucleotide sequence encoding a polypeptide having NADPH-cytochrome p450 reductase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 54, 56, 58 or 78;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 53, 55, 57 or 77;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code, Preferably, a recombinant microorganism suitable for use in a method of the invention is one which is capable of expressing one or more of:
 a. a nucleotide sequence encoding a polypeptide having ent-copalyl pyrophosphate synthase activity, wherein said nucleotide sequence comprises:
  i. a nucleotide sequence encoding a polypeptide having ent-copalyl pyrophosphate synthase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 2, 4, 6, 8, 18, 20, 60 or 62;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 1, 3, 5, 7, 17, 19, 59 or 61, 141, 142, 151, 152, 153, 154, 159, 160, 182 or 184;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code,
 b. a nucleotide sequence encoding a polypeptide having ent-Kaurene synthase activity, wherein said nucleotide sequence comprises:
  i. a nucleotide sequence encoding a polypeptide having ent-Kaurene synthase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 10, 12, 14, 16, 18, 20, 64 or 66;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 9, 11, 13, 15, 17, 19, 63, 65, 143, 144, 155, 156, 157, 158, 159, 160, 183 or 184;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code,
 c. a nucleotide sequence encoding a polypeptide having ent-Kaurene oxidase activity, wherein said nucleotide sequence comprises:
  i. a nucleotide sequence encoding a polypeptide having ent-Kaurene oxidase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 22, 24, 26, 68 or 86;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 21, 23, 25, 67, 85, 145, 161, 162, 163, 180 or 186;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code; or d. a nucleotide sequence encoding a polypeptide having kaurenoic acid 13-hydroxylase activity, wherein said nucleotide sequence comprises:
i. a nucleotide sequence encoding a polypeptide having kaurenoic acid 13-hydroxylase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 28, 30, 32, 34, 70, 90, 92, 94, 96 or 98;
ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 27, 29, 31, 33, 69, 89, 91, 93, 95, 97, 146, 164, 165, 166, 167 or 185;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism suitable for use in a method of the invention, which is capable of expressing a nucleotide sequence encoding a polypeptide capable of catalyzing the addition of a C-13-glucose to steviol, said nucleotide may comprise:
i. a nucleotide sequence encoding a polypeptide capable of catalyzing the addition of a C-13-glucose to steviol, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 36, 38 or 72;
ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 35, 37, 71, 147, 168, 169 or 189;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism suitable for use in a method of the invention, which is capable of expressing a nucleotide sequence encoding a polypeptide capable of catalyzing the addition of a glucose at the C-13 position of steviolmonoside (this typically indicates glucosylation of the C-2' of the C-13-glucose/13-O-glucose of steviolmonoside), said nucleotide sequence may comprise:
i. a nucleotide sequence encoding a polypeptide capable of catalyzing the addition of a C-13-glucose to steviol or steviolmonoside, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 88, 100, 102, 104, 106, 108, 110 or 112;
ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 87, 99, 101, 103, 105, 107, 109, 111, 181 or 192;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism suitable for use in a method of the invention, which is capable of expressing a nucleotide sequence encoding a polypeptide capable of catalyzing the addition of a glucose at the C-19 position of steviolbioside, said nucleotide sequence may comprise:
i. a nucleotide sequence encoding a polypeptide capable of catalyzing the addition of a glucose at the C-19 position of steviolbioside, said polypeptide comprising an amino acid sequence that has at least about 20% sequence identity with the amino acid sequence of SEQ ID NOs: 40, 42, 44, 46, 48 or 74;
ii. a nucleotide sequence that has at least about 15% sequence identity with the nucleotide sequence of SEQ ID NOs: 39, 41, 43, 45, 47, 73, 148, 170, 171, 172, 173, 174 or 190;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism suitable for use in a method of the invention, which expresses a nucleotide sequence encoding a polypeptide capable of catalyzing glucosylation of the C-3' of the glucose at the C-13 position of stevioside, said nucleotide sequence may comprise:
i. a nucleotide sequence encoding a polypeptide capable of catalyzing glucosylation of the C-3' of the glucose at the C-13 position of stevioside, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 50, 52 or 76;
ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 49, 51, 75, 149, 175, 176 or 191;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism suitable for use in a method of the invention, which expresses a nucleotide sequence encoding a polypeptide capable of catalysing one or more of: the glucosylation of stevioside or rebaudioside A to rebaudioside D; the glucosylation of stevioside to rebaudioside E; the glucosylation of rebaudioside E to rebaudioside D; or the glucosylation of rebaudioside D to rebaudioside M, said nucleotide sequence may comprise:

i. a nucleotide sequence encoding a polypeptide capable of catalysing one or more of: the glucosylation of stevioside or rebaudioside A to rebaudioside D; the glucosylation of stevioside to rebaudioside E; the glucosylation of rebaudioside E to rebaudioside D; or the glucosylation of rebaudioside D to rebaudioside M, said polypeptide comprising an amino acid sequence that has at least about 20% sequence identity with the amino acid sequence of SEQ ID NOs: 88, 100, 102, 104, 106, 108, 110, 112;

ii. a nucleotide sequence that has at least about 15% sequence identity with the nucleotide sequence of SEQ ID NOs: 87, 99, 101, 103, 105, 107, 109, 111, 181 or 192;

iii. a nucleotide sequence the complementary strand of which hybridizes to a nucleic acid molecule of sequence of (i) or (ii); or iv. a nucleotide sequence which differs from the sequence of a nucleic acid molecule of (i), (ii) or (iii) due to the degeneracy of the genetic code.

A microorganism suitable for use in a method according to the invention, may be one in which the ability of the microorganism to produce geranylgeranyl pyrophosphate (GGPP) is upregulated. Upregulated in the context of this invention implies that the microorganism produces more GGPP than an equivalent non-transformed strain.

Accordingly, a microorganism suitable for use in a method of the invention may comprise one or more nucleotide sequence(s) encoding hydroxymethylglutaryl-CoA reductase, farnesyl-pyrophosphate synthetase and geranylgeranyl diphosphate synthase, whereby the nucleotide sequence(s) upon transformation of the microorganism confer(s) on the microorganism the ability to produce elevated levels of GGPP.

Preferably, a microorganism suitable for use in a method according to the invention is one which is capable of expressing one or more of:

a. a nucleotide sequence encoding a polypeptide having hydroxymethylglutaryl-CoA reductase activity, wherein said nucleotide sequence comprises:

i. a nucleotide sequence encoding a polypeptide having hydroxymethylglutaryl-CoA reductase activity, said polypeptide comprising an amino acid sequence that has at least about 20% sequence identity with the amino acid sequence of SEQ ID NO: 80;

ii. a nucleotide sequence that has at least about 15% sequence identity with the nucleotide sequence of SEQ ID NO: 79;

iii. a nucleotide sequence the complementary strand of which hybridizes to a nucleic acid molecule of sequence of (i) or (ii); or iv. a nucleotide sequence which differs from the sequence of a nucleic acid molecule of (i), (ii) or (iii) due to the degeneracy of the genetic code, b. a nucleotide sequence encoding a polypeptide having farnesyl-pyrophosphate synthetase activity, wherein said nucleotide sequence comprises:

i. a nucleotide sequence encoding a polypeptide having farnesyl-pyrophosphate synthetase activity, said polypeptide comprising an amino acid sequence that has at least about 20% sequence identity with the amino acid sequence of SEQ ID NO: 82;

ii. a nucleotide sequence that has at least about 15% sequence identity with the nucleotide sequence of SEQ ID NOs: 81;

iii. a nucleotide sequence the complementary strand of which hybridizes to a nucleic acid molecule of sequence of (i) or (ii); or iv. a nucleotide sequence which differs from the sequence of a nucleic acid molecule of (iii) due to the degeneracy of the genetic code: or c. a nucleotide sequence encoding a polypeptide having geranylgeranyl diphosphate synthase activity, wherein said nucleotide sequence comprises:

i. a nucleotide sequence encoding a polypeptide having geranylgeranyl diphosphate synthase activity, said polypeptide comprising an amino acid sequence that has at least about 20% sequence identity with the amino acid sequence of SEQ ID NO: 84;

ii. a nucleotide sequence that has at least about 15% sequence identity with the nucleotide sequence of SEQ ID NOs: 83;

iii. a nucleotide sequence the complementary strand of which hybridizes to a nucleic acid molecule of sequence of (i) or (ii); or iv. a nucleotide sequence which differs from the sequence of a nucleic acid molecule of (i), (ii) or (iii) due to the degeneracy of the genetic code.

The process of the invention comprises the use of a recombinant microorganism. A microorganism or microbe, for the purposes of this invention, is typically an organism that is not visible to the human eye (i.e. microscopic). A microorganism may be from bacteria, fungi, archaea or protists. Typically a microorganism will be a single-celled or unicellular organism.

As used herein a recombinant microorganism of the genus *Yarrowia* is defined as such a microorganism which is genetically modified or transformed/transfected with one or more of the nucleotide sequences as defined herein. The presence of the one or more such nucleotide sequences alters the ability of the microorganism to produce a diterpene or diterpene glycoside, in particular steviol or steviol glycoside. A microorganism that is not transformed/transfected or genetically modified, is not a recombinant microorganism and does typically not comprise one or more of the nucleotide sequences enabling the cell to produce a diterpene or diterpene glycoside. Hence, a non-transformed/non-transfected microorganism is typically a microorganism that does not naturally produce a diterpene, although a microorganism which naturally produces a diterpene or diterpene glycoside and which has been modified according to the invention (and which thus has an altered ability to produce a diterpene/diterpene glycoside) is considered a recombinant microorganism according to the invention.

Sequence identity is herein defined as a relationship between two or more amino acid (polypeptide or protein) sequences or two or more nucleic acid (polynucleotide) sequences, as determined by comparing the sequences. Usually, sequence identities or similarities are compared over the whole length of the sequences compared. In the art, "identity" also means the degree of sequence relatedness between amino acid or nucleic acid sequences, as the case may be, as determined by the match between strings of such sequences. "Identity" and "similarity" can be readily calculated by various methods, known to those skilled in the art. Preferred methods to determine identity are designed to give the largest match between the sequences tested. Typically then, identities and similarities are calculated over the entire length of the sequences being compared. Methods to determine identity and similarity are codified in publicly available computer programs. Preferred computer program methods to determine identity and similarity between two sequences include e.g. the BestFit, BLASTP, BLASTN, and FASTA (Altschul, S. F. et al., J. Mol. Biol. 215:403-410 (1990), publicly available from NCBI and other sources (BLAST Manual, Altschul, S., et al., NCBI NLM NIH Bethesda, Md. 20894). Preferred parameters for amino acid sequences comparison using BLASTP are gap open 10.0, gap extend 0.5, Blosum 62 matrix. Preferred parameters for nucleic acid sequences comparison using BLASTP are gap open 10.0, gap extend 0.5, DNA full matrix (DNA identity matrix).

Nucleotide sequences encoding the enzymes expressed in the cell of the invention may also be defined by their capability to hybridize with the nucleotide sequences of SEQ ID NO.'s 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81 or 84 or any other sequence mentioned herein respectively, under moderate, or preferably under stringent hybridisation conditions. Stringent hybridisation conditions are herein defined as conditions that allow a nucleic acid sequence of at least about 25, preferably about 50 nucleotides, 75 or 100 and most preferably of about 200 or more nucleotides, to hybridise at a temperature of about 65° C. in a solution comprising about 1 M salt, preferably 6×SSC or any other solution having a comparable ionic strength, and washing at 65° C. in a solution comprising about 0.1 M salt, or less, preferably 0.2×SSC or any other solution having a comparable ionic strength. Preferably, the hybridisation is performed overnight, i.e. at least for 10 hours and preferably washing is performed for at least one hour with at least two changes of the washing solution. These conditions will usually allow the specific hybridisation of sequences having about 90% or more sequence identity.

Moderate conditions are herein defined as conditions that allow a nucleic acid sequences of at least 50 nucleotides, preferably of about 200 or more nucleotides, to hybridise at a temperature of about 45° C. in a solution comprising about 1 M salt, preferably 6×SSC or any other solution having a comparable ionic strength, and washing at room temperature in a solution comprising about 1 M salt, preferably 6×SSC or any other solution having a comparable ionic strength. Preferably, the hybridisation is performed overnight, i.e. at least for 10 hours, and preferably washing is performed for at least one hour with at least two changes of the washing solution. These conditions will usually allow the specific hybridisation of sequences having up to 50% sequence identity. The person skilled in the art will be able to modify these hybridisation conditions in order to specifically identify sequences varying in identity between 50% and 90%.

The nucleotide sequences encoding an ent-copalyl pyrophosphate synthase; ent-Kaurene synthase; ent-Kaurene oxidase; kaurenoic acid 13-hydroxylase; UGT; hydroxymethylglutaryl-CoA reductase, farnesyl-pyrophosphate synthetase; geranylgeranyl diphosphate synthase; NADPH-cytochrome p450 reductase, may be from prokaryotic or eukaryotic origin.

A nucleotide sequence encoding an ent-copalyl pyrophosphate synthase may for instance comprise a sequence as set out in SEQ ID. NO: 1, 3, 5, 7, 17, 19, 59, 61, 141, 142, 151, 152, 153, 154, 159, 160, 182 or 184.

A nucleotide sequence encoding an ent-Kaurene synthase may for instance comprise a sequence as set out in SEQ ID. NO: 9, 11, 13, 15, 17, 19, 63, 65, 143, 144, 155, 156, 157, 158, 159, 160, 183 or 184.

A nucleotide sequence encoding an ent-Kaurene oxidase may for instance comprise a sequence as set out in SEQ ID. NO: 21, 23, 25, 67, 85, 145, 161, 162, 163, 180 or 186. A preferred KO is the polypeptide encoded by the nucleic acid set out in SEQ ID NO: 85.

A nucleotide sequence encoding a kaurenoic acid 13-hydroxylase may for instance comprise a sequence as set out in SEQ ID. NO: 27, 29, 31, 33, 69, 89, 91, 93, 95, 97, 146, 164, 165, 166, 167 or 185. A preferred KAH sequence is the polypeptide encoded by the nucleic acid set out in SEQ ID NO: 33.

A further preferred recombinant microorganism of the invention may express a combination of the polypeptides encoded by SEQ ID NO: 85 and SEQ ID NO: 33 or a variant of either thereof as herein described. A preferred recombinant microorganism of the invention may expression the combination of sequences set out in Table 8 (in combination with any UGT2, but in particular that encoded by SEQ ID NO: 87).

A nucleotide sequence encoding a UGT may for instance comprise a sequence as set out in SEQ ID. NO: 35, 37, 39, 41, 43, 45, 47, 49, 51, 71, 73, 75, 168, 169, 170, 171, 172, 173, 174, 175, 176, 147, 148, 149, 87, 181, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 189, 190, 191 or 192.

A nucleotide sequence encoding a hydroxymethylglutaryl-CoA reductase may for instance comprise a sequence as set out in SEQ ID. NO: 79.

A nucleotide sequence encoding a farnesyl-pyrophosphate synthetase may for instance comprise a sequence as set out in SEQ ID. NO: 81.

A nucleotide sequence encoding a geranylgeranyl diphosphate synthase may for instance comprise a sequence as set out in SEQ ID. NO:83.

A nucleotide sequence encoding a NADPH-cytochrome p450 reductase may for instance comprise a sequence as set out in SEQ ID. NO: 53, 55, 57 or 77.

In the case of the UGT sequences, combinations of at least one from each of: (i) SEQ ID NOs: 35, 37, 168, 169, 71, 147 or 189; (ii) SEQ ID NOs: 87, 99, 101, 103, 105, 107, 109, 111, 181 or 192; (iii) SEQ ID NOs: 39, 41, 43, 45, 47, 170, 171, 172, 173, 174, 73, 148 or 190; and (iv) SEQ ID NOs: 49, 51, 175, 176, 75, 149 or 191 may be preferred. Typically, at least one UGT from group (i) may be used. If at least one UGT from group (iii) is used, generally at least one UGT from group (i) is also used. If at least one UGT from group (iv) is used, generally at least one UGT from group (i) and at least one UGT from group (iii) is used. Typically, at least one UGT form group (ii) is used.

A sequence which has at least about 10%, about 15%, about 20%, preferably at least about 25%, about 30%, about 40%, about 50%, about 55%, about 60%, about 65%, about 70%, about 75%, about 80%, about 85%, about 90%, about 95%, about 96%, about 97%, about 98%, or about 99% sequence identity with a sequence as mentioned may be used in the invention.

To increase the likelihood that the introduced enzymes are expressed in active form in a cell, the corresponding encoding nucleotide sequence may be adapted to optimise its codon usage to that of the chosen eukaryote host cell. The adaptiveness of the nucleotide sequences encoding the enzymes to the codon usage of the chosen host cell may be expressed as codon adaptation index (CAI). The codon adaptation index is herein defined as a measurement of the relative adaptiveness of the codon usage of a gene towards the codon usage of highly expressed genes. The relative adaptiveness (w) of each codon is the ratio of the usage of each codon, to that of the most abundant codon for the same amino acid. The CAI index is defined as the geometric mean of these relative adaptiveness values. Non-synonymous codons and termination codons (dependent on genetic code) are excluded. CAI values range from 0 to 1, with higher values indicating a higher proportion of the most abundant codons (see Sharp and Li, 1987, Nucleic Acids Research 15: 1281-1295; also see: Jansen et al., 2003, Nucleic Acids Res. 31(8):2242-51). An adapted nucleotide sequence preferably has a CAI of at least 0.2, 0.3, 0.4, 0.5, 0.6 or 0.7.

In a preferred embodiment the eukaryotic cell according to the present invention is genetically modified with (a) nucleotide sequence(s) which is (are) adapted to the codon usage of the eukaryotic cell using codon pair optimisation technology as disclosed in PCT/EP2007/05594. Codon-pair optimisation is a method for producing a polypeptide in a host cell, wherein the nucleotide sequences encoding the polypeptide have been modified with respect to their codon-usage, in particular the codon-pairs that are used, to obtain improved expression of the nucleotide sequence encoding the polypeptide and/or improved production of the polypeptide. Codon pairs are defined as a set of two subsequent triplets (codons) in a coding sequence.

Further improvement of the activity of the enzymes in vivo in a eukaryotic host cell of the invention, can be obtained by well-known methods like error prone PCR or directed evolution. A preferred method of directed evolution is described in WO03010183 and WO03010311.

A recombinant microorganism suitable for use in a method according to the invention may be modified so that the ERG9 gene is down-regulated and or the ERG5/ERG6 genes are deleted. Corresponding genes may be modified in this way in other microorganisms.

Such a microorganism may be transformed as set out herein, whereby the nucleotide sequence(s) with which the microorganism is transformed confer(s) on the cell the ability to produce a diterpene or glycoside thereof.

A preferred microorganism for use in the invention is a *Yarrowia lipolytica* cell. A recombinant *Yarrowia lipolytica* cell may comprise one or more nucleotide sequence(s) from each of the following groups;

(i) SEQ ID. NO: 1, 3, 5, 7, 17, 19, 59, 61, 141, 142, 152, 153, 154, 159, 160, 182 or 184.

(ii) SEQ ID. NO: 9, 11, 13, 15, 17, 19, 63, 65, 143, 144, 155, 156, 157, 158, 159, 160, 183 or 184.

(iii) SEQ ID. NO: 21, 23, 25, 67 85, 145, 161, 162, 163, 180 or 186.

(iv) SEQ ID. NO: 27, 29, 31, 33, 69, 89, 91, 93, 95, 97, 146, 164, 165, 166, 167 or 185.

Such a microorganism will typically also comprise one or more nucleotide sequence(s) as set out in SEQ ID. NO: 53, 55, 57 or 77.

Such a microorganism may also comprise one or more nucleotide sequences as set out in 35, 37, 39, 41, 43, 45, 47, 49, 51, 71, 73, 75, 168, 169, 170, 171, 172, 173, 174, 175, 176, 147, 148, 149, 87, 181, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 189, 190, 191 or 192. In the case of these sequences, combinations of at least one from each of (i) SEQ ID NOs: 35, 37, 168, 169, 71, 147 or 189; (ii) SEQ ID NOs: 87, 99, 101, 103, 105, 107, 109, 111, 181 or 192; (iii) SEQ ID NOs: 39, 41, 43, 45, 47, 170, 171, 172, 173, 174, 73, 148 or 190; and (iv) SEQ ID NOs: 49, 51, 175, 176, 75, 149 or 191 may be preferred. Typically, at least one UGT from group (i) may be used. If at least one UGT from group (iii) is used, generally at least one UGT from group (i) is also used. If at least one UGT from group (iv) is used, generally at least one UGT from group (i) and at least one UGT from group (iii) is used. Typically, at least one UGT form group (ii) is used.

Such a microorganism may also comprise the following nucleotide sequences: SEQ ID. NO: 79; SEQ ID. NO: 81; and SEQ ID. NO: 83.

For each sequence set out above (or any sequence mentioned herein), a variant having at least about 15%, preferably at least about 20, about 25, about 30, about 40, about 50, about 55, about 60, about 65, about 70, about 75, about 80, about 85, about 90, about 95, about 96, about 97, about 98, or about 99%, sequence identity with the stated sequence may be used.

The nucleotide sequences encoding the ent-copalyl pyrophosphate synthase, ent-Kaurene synthase, ent-Kaurene oxidase, kaurenoic acid 13-hydroxylase, UGTs, hydroxymethylglutaryl-CoA reductase, farnesyl-pyrophosphate synthetase, geranylgeranyl diphosphate synthase and NADPH-cytochrome p450 reductase may be ligated into one or more nucleic acid constructs to facilitate the transformation of the microorganism according to the present invention.

A nucleic acid construct may be a plasmid carrying the genes encoding enzymes of the diterpene, eg. steviolisteviol glycoside, pathway as described above, or a nucleic acid construct may comprise two or three plasmids carrying each three or two genes, respectively, encoding the enzymes of the diterpene pathway distributed in any appropriate way.

Any suitable plasmid may be used, for instance a low copy plasmid or a high copy plasmid.

It may be possible that the enzymes selected from the group consisting of ent-copalyl pyrophosphate synthase, ent-Kaurene synthase, ent-Kaurene oxidase, and kaurenoic acid 13-hydroxylase, UGTs, hydroxymethylglutaryl-CoA reductase, farnesyl-pyrophosphate synthetase, geranylgeranyl diphosphate synthase and NADPH-cytochrome p450 reductase are native to the host microorganism and that transformation with one or more of the nucleotide sequences encoding these enzymes may not be required to confer the host cell the ability to produce a diterpene or diterpene glycosidase. Further improvement of diterpene/diterpene glycosidase production by the host microorganism may be obtained by classical strain improvement.

The nucleic acid construct may be maintained episomally and thus comprise a sequence for autonomous replication, such as an autosomal replication sequence sequence. If the host cell is of fungal origin, a suitable episomal nucleic acid construct may e.g. be based on the yeast 2μ or pKD1 plasmids (Gleer et al., 1991, Biotechnology 9: 968-975), or the AMA plasmids (Fierro et al., 1995, Curr Genet. 29:482-489).

Alternatively, each nucleic acid construct may be integrated in one or more copies into the genome of the host cell. Integration into the host cell's genome may occur at random by non-homologous recombination but preferably the nucleic acid construct may be integrated into the host cell's genome by homologous recombination as is well known in the art (see e.g. WO90/14423, EP-A-0481008, EP-A-0635 574 and U.S. Pat. No. 6,265,186).

Optionally, a selectable marker may be present in the nucleic acid construct. As used herein, the term "marker" refers to a gene encoding a trait or a phenotype which permits the selection of, or the screening for, a microorganism containing the marker. The marker gene may be an antibiotic resistance gene whereby the appropriate antibiotic can be used to select for transformed cells from among cells that are not transformed. Alternatively or also, non-antibiotic resistance markers are used, such as auxotrophic markers (URA3, TRP1, LEU2). The host cells transformed with the nucleic acid constructs may be marker gene free. Methods for constructing recombinant marker gene free microbial host cells are disclosed in EP-A-0 635 574 and are based on the use of bidirectional markers. Alternatively, a screenable marker such as Green Fluorescent Protein, lacZ, luciferase, chloramphenicol acetyltransferase, beta-glucuronidase may be incorporated into the nucleic acid constructs of the invention allowing to screen for transformed cells. A preferred marker-free method for the introduction of heterologous polynucleotides is described in WO0540186.

In a preferred embodiment, the nucleotide sequences encoding ent-copalyl pyrophosphate synthase, ent-Kaurene synthase, ent-Kaurene oxidase, and kaurenoic acid 13-hydroxylase, UGTs, hydroxymethylglutaryl-CoA reductase, farnesyl-pyrophosphate synthetase, geranylgeranyl diphosphate synthase and NADPH-cytochrome p450 reductase, are each operably linked to a promoter that causes sufficient expression of the corresponding nucleotide sequences in the eukaryotic cell according to the present invention to confer to the cell the ability to produce a diterpene or diterpene glycoside.

As used herein, the term "operably linked" refers to a linkage of polynucleotide elements (or coding sequences or nucleic acid sequence) in a functional relationship. A nucleic acid sequence is "operably linked" when it is placed into a functional relationship with another nucleic acid sequence. For instance, a promoter or enhancer is operably linked to a coding sequence if it affects the transcription of the coding sequence.

As used herein, the term "promoter" refers to a nucleic acid fragment that functions to control the transcription of one or more genes, located upstream with respect to the direction of transcription of the transcription initiation site of the gene, and is structurally identified by the presence of a binding site for DNA-dependent RNA polymerase, transcription initiation sites and any other DNA sequences, including, but not limited to transcription factor binding sites, repressor and activator protein binding sites, and any other sequences of nucleotides known to one of skilled in the art to act directly or indirectly to regulate the amount of transcription from the promoter. A "constitutive" promoter is a promoter that is active under most environmental and developmental conditions. An "inducible" promoter is a promoter that is active under environmental or developmental regulation.

The promoter that could be used to achieve the expression of the nucleotide sequences coding for an enzyme as defined herein above, may be not native to the nucleotide sequence coding for the enzyme to be expressed, i.e. a promoter that is heterologous to the nucleotide sequence (coding sequence) to which it is operably linked. Preferably, the promoter is homologous, i.e. endogenous to the host cell Suitable promoters in microorganisms of the invention may be GAL7, GAL10, or GAL 1, CYC1, HIS3, ADH1, PGL, PH05, GAPDH, ADC1, TRP1, URA3, LEU2, ENO, TPI, and AOX1. Other suitable promoters include PDC, GPD1, PGK1, TEF1, and TDH. Further suitable promoters are set out in the Examples.

Any terminator, which is functional in the cell, may be used in the present invention. Preferred terminators are obtained from natural genes of the host cell. Suitable terminator sequences are well known in the art. Preferably, such terminators are combined with mutations that prevent nonsense mediated mRNA decay in the host cell of the invention (see for example: Shirley et al., 2002, Genetics 161:1465-1482).

Nucleotide sequences used in the invention may include sequences which target them to desired compartments of the microorganism. For example, in a preferred microorganism of the invention, all nucleotide sequences, except for ent-Kaurene oxidase, kaurenoic acid 13-hydroxylase and NADPH-cytochrome p450 reductase encoding sequences may be targeted to the cytosol. This approach may be used in a cell of the genus Yarrowia.

The term "homologous" when used to indicate the relation between a given (recombinant) nucleic acid or polypeptide molecule and a given host organism or host cell, is understood to mean that in nature the nucleic acid or polypeptide molecule is produced by a host cell or organisms of the same species, preferably of the same variety or strain.

The term "heterologous" when used with respect to a nucleic acid (DNA or RNA) or protein refers to a nucleic acid or protein that does not occur naturally as part of the organism, cell, genome or DNA or RNA sequence in which it is present, or that is found in a cell or location or locations in the genome or DNA or RNA sequence that differ from that in which it is found in nature. Heterologous nucleic acids or proteins are not endogenous to the cell into which it is introduced, but have been obtained from another cell or synthetically or recombinantly produced.

Typically, a recombinant microorganism suitable for use in a method of the invention will comprise heterologous nucleotide sequences. Alternatively, a recombinant microorganism suitable for use in a method of the invention may comprise entirely homologous sequence which has been modified as set out herein so that the microorganism produces increased amounts of a diterpene and/or diterpene glycoside in comparison to a non-modified version of the same microorganism.

One or more enzymes of the diterpene pathway as described herein may be overexpressed to achieve a sufficient diterpene production by the cell.

There are various means available in the art for overexpression of enzymes in the host cells of the invention. In particular, an enzyme may be overexpressed by increasing the copy number of the gene coding for the enzyme in the host cell, e.g. by integrating additional copies of the gene in the host cell's genome.

A preferred host cell according to the present invention may be a recombinant cell which is naturally capable of producing GGPP.

A recombinant microorganism suitable for use in a method according to the present invention may be able to grow on any suitable carbon source known in the art and convert it to a diterpene or a diterpene glycoside. The recombinant microorganism may be able to convert directly plant biomass, celluloses, hemicelluloses, pectines, rhamnose, galactose, fucose, maltose, maltodextrines, ribose, ribulose, or starch, starch derivatives, sucrose, lactose and glycerol. Hence, a preferred host organism expresses enzymes such as cellulases (endocellulases and exocellulases) and hemicellulases (e.g. endo- and exo-xylanases, arabinases) necessary for the conversion of cellulose into glucose monomers and hemicellulose into xylose and arabinose monomers, pectinases able to convert pectines into glucuronic acid and galacturonic acid or amylases to convert starch into glucose monomers. Preferably, the host cell is able to convert a carbon source selected from the group consisting of glucose, xylose, arabinose, sucrose, lactose and glycerol. The host cell may for instance be a eukaryotic host cell as described in WO03/062430, WO06/009434, EP1499708B1, WO2006096130 or WO04/099381.

The present invention relates to a process for the production of a diterpene or diterpene glycoside comprising fermenting a recombinant microorganism as described herein in a suitable fermentation medium, and recovering the diterpene and/or diterpene glycoside from the fermentation medium.

The fermentation medium used in the process for the production of a diterpene or diterpene glycoside may be any suitable fermentation medium which allows growth of the recombinant cell. The essential elements of suitable fermentation media are known to the person skilled in the art and may be adapted to the specific cell which is used.

Preferably, the fermentation medium comprises a carbon source selected from the group consisting of plant biomass, celluloses, hemicelluloses, pectines, rhamnose, galactose, fucose, fructose, maltose, maltodextrines, ribose, ribulose, or starch, starch derivatives, sucrose, lactose, fatty acids, triglycerides and glycerol. Preferably, the fermentation medium also comprises a nitrogen source such as ureum, or an ammonium salt such as ammonium sulphate, ammonium chloride, ammoniumnitrate or ammonium phosphate.

The fermentation process according to the present invention may be carried out in batch, fed-batch or continuous mode. A separate hydrolysis and fermentation (SHF) process or a simultaneous saccharification and fermentation (SSF) process may also be applied. A combination of these fermentation process modes may also be possible for optimal productivity. A SSF process may be particularly attractive if starch, cellulose, hemicelluose or pectin is used as a carbon source in the fermentation process, where it may be necessary to add hydrolytic enzymes, such as cellulases, hemicellulases or pectinases to hydrolyse the substrate.

The recombinant microorganism used in the process for the preparation of a diterpene or diterpene glycoside may be any suitable microorganism as defined herein above. The cells may be grown at low pH to prevent bacterial contamination.

The fermentation process for the production of a diterpene according to the present invention may be an aerobic or an anaerobic fermentation process.

An anaerobic fermentation process may be herein defined as a fermentation process run in the absence of oxygen or in which substantially no oxygen is consumed, preferably less than 5, 2.5 or 1 mmol/L/h, and wherein organic molecules serve as both electron donor and electron acceptors. The fermentation process according to the present invention may also first be run under aerobic conditions and subsequently under anaerobic conditions.

The fermentation process may also be run under oxygen-limited, or micro-aerobical, conditions. Alternatively, the fermentation process may first be run under aerobic conditions and subsequently under oxygen-limited conditions. An oxygen-limited fermentation process is a process in which the oxygen consumption is limited by the oxygen transfer from the gas to the liquid. The degree of oxygen limitation is determined by the amount and composition of the ingoing gasflow as well as the actual mixing/mass transfer properties of the fermentation equipment used.

The production of a diterpene in the process according to the present invention may occur during the growth phase of the host cell, during the stationary (steady state) phase or during both phases. It may be possible to run the fermentation process at different temperatures.

The process for the production of a diterpene or diterpene glycoside may be run at a temperature which is optimal for the eukaryotic cell. The optimum growth temperature may differ for each transformed eukaryotic cell and is known to the person skilled in the art. The optimum temperature might be higher than optimal for wild type organisms to grow the organism efficiently under non-sterile conditions under minimal infection sensitivity and lowest cooling cost. Alternatively, the process may be carried out at a temperature which is not optimal for growth of the recombinant microorganism. Indeed, we have shown that a process for the preparation of a diterpene or diterpene glycoside may be carried out beneficially at a sub-optimal growth temperature of a recombinant microorganism.

In the process for the production of a diterpene or diterpene glycoside according to the invention, it may be possible to achieve a concentration of above 5 mg/l fermentation broth, preferably above 10 mg/l, preferably above 20 mg/l, preferably above 30 mg/l fermentation broth, preferably above 40 mg/l, more preferably above 50 mg/l, preferably above 60 mg/l, preferably above 70, preferably above 80 mg/l, preferably above 100 mg/l, preferably above 1 g/l, preferably above 5 g/l, preferably above 10 g/l, but usually below 70 g/l.

Critically, in the process of the invention, one or more diterpene or glycosylated diterpene is produced extracellularly. That is to say, the process is such that the one or more diterpene or glycosylated diterpene is present in the fermentation medium. For the purposes of the invention, extracellular production is typically indicated where at at least about 30% of one or more diterpene or glycosylated diterpene is produced extracellularly (i.e. present in the fermentation medium). The percentage given indicates how much of the one or more diterpene or glycosylated diterpene is present in the fermentation medium as compared with how much remains within the recombinant microorganism. That is to say, at least about 30% of all of the one or more diterpene or glycosylated diterpene produced by the recombinant microorganism is produced extracellularly.

The amount of one or more diterpene or glycosylated diterpene produced extracellular In the process of the invention, at least about 40%, at least about 50%, at least about 60%, at least about 70%, at least about 80%, at least about 90%, at least about 95% or more of one or more diterpenes or glycosylated diterpenes is produced extracellularly.

The temperature for growth of the recombinant microorganism in a process for production of a diterpene or diterpene glycoside may be above 20° C., 22° C., 25° C., 28° C., or above 30° C., 35° C., or above 37° C., 40° C., 42° C., and preferably below 45° C. During the production phase of a diterpene or diterpene glycoside however, the optimum temperature might be lower than average in order to optimize biomass stability. The temperature during this phase may be below 45° C., for instance below 42° C., 40° C., 37° C., for instance below 35° C., 30° C., or below 28° C., 25° C., 22° C. or below 20° C. preferably above 15° C.

The invention thus provides a process for the preparation of a diterpene or glycosylated diterpene which process comprises fermenting a recombinant microorganism capable of producing a diterpene or glycosylate diterpene in a suitable fermentation medium at a temperature of about 29° C. or higher, and optionally recovering the diterpene or glycosylated diterpene. The microorganism is a microorganism of the genus *Yarrowia*.

The temperature of fermentation in such a process may be about 29° C. or higher, about 30° C. or higher, about 31° C.

or higher, about 32° C. or higher, about 33° C. or higher or about 34° C. or higher. Thus the fermentation temperature may be from about 29° C. to about 34° C., for example from about 30° C. to about 34° C., such as from about 32° C. to about 34° C.

During the production phase of a diterpene or diterpene glycoside however, the optimum temperature might be lower than average in order to optimize biomass stability. The temperature during this phase may be at from about 29° C. to about 30° C.

The temperature may then be raised during the steviol glycoside production phase to from about 32° C. to about 3400.

The process for the production of a diterpene or diterpene glycoside according to the present invention may be carried out at any suitable pH value. If the recombinant microorganism is of the genus *Yarrowia*, the pH in the fermentation medium preferably has a value of below 6, preferably below 5.5, preferably below 5, preferably below 4.5, preferably below 4, preferably below pH 3.5 or below pH 3.0, or below pH 2.5, preferably above pH 2. An advantage of carrying out the fermentation at these low pH values is that growth of contaminant bacteria in the fermentation medium may be prevented.

Such a process may be carried out on an industrial scale.

The product of such a process may be one or more of steviolmonoside, steviolbioside, stevioside or rebaudioside A, rebaudioside B, rebaudioside C, rebaudioside D, rebaudioside E, rebaudioside F, rebaudioside M, rubusoside, dulcoside A. Preferably, rebaudioside A, rebaudioside D or rebaudioside M is produced.

Recovery of the diterpene or diterpene glycoside from the fermentation medium may be performed by known methods in the art, for instance by distillation, vacuum extraction, solvent extraction, or evaporation.

The present invention also relates to a fermentation broth comprising a diterpene and/or diterpene glycoside obtainable by the process according to the present invention. The diterpene or glycosylated diterpene may be a steviol glycoside, in particular rebaudioside A, rebaudioside D or rebaudioside M.

In the event that a diterpene or diterpene glycoside is expressed within the microorganism, such cells may need to be treated so as to release the diterpene/diterpene glycoside.

The diterpene or diterpene glycoside, for example rebaudioside A, rebaudioside D or rebaudioside M, produced by the fermentation process according to the present invention may be used in any application known for such compounds. In particular, they may for instance be used as a sweetener, for example in a food or a beverage. For example steviol glycosides may be formulated in soft drinks, juices, as a tabletop sweetener, chewing gum, dairy product such as yoghurt (eg. plain yoghurt), cake, cereal or cereal-based food, nutraceutical, pharmaceutical, edible gel, confectionery product, cosmetic, toothpastes or other oral cavity composition, etc. In addition, a diterpene or diterpene glycoside can be used as a sweetener not only for drinks, foodstuffs, and other products dedicated for human consumption, but also in animal feed and fodder with improved characteristics.

Accordingly, the invention provides, inter alia, a foodstuff, feed or beverage which comprises a diterpene or glycosylated prepared according to a process of the invention.

During the manufacturing of foodstuffs, drinks, pharmaceuticals, cosmetics, table top products, chewing gum the conventional methods such as mixing, kneading, dissolution, pickling, permeation, percolation, sprinkling, atomizing, infusing and other methods can be used.

The diterpene or diterpene glycoside obtained in this invention can be used in dry or liquid forms. It can be added before or after heat treatment of food products. The amount of the sweetener depends on the purpose of usage. It can be added alone or in the combination with other compounds.

Compounds produced according to the method of the invention may be blended with one or more further non-calorific or calorific sweeteners. Such blending may be used to improve flavour or temporal profile or stability. A wide range of both non-calorific and calorific sweeteners may be suitable for blending with steviol glycosides. For example, non-calorific sweeteners such as mogroside, monatin, aspartame, acesulfame salts, cyclamate, sucralose, saccharin salts or erythritol. Calorific sweeteners suitable for blending with steviol glycosides include sugar alcohols and carbohydrates such as sucrose, glucose, fructose, invert sugar and HFCS. Sweet tasting amino acids such as glycine, alanine or serine may also be used.

The diterpene or diterpene glycoside can be used in the combination with a sweetener suppressor, such as a natural sweetener suppressor. It may be combined with an umami taste enhancer, such as an amino acid or a salt thereof.

A diterpene or diterpene glycoside can be combined with a polyol or sugar alcohol, a carbohydrate, a physiologically active substance or functional ingredient (for example a carotenoid, dietary fiber, fatty acid, saponin, antioxidant, nutraceutical, flavonoid, isothiocyanate, phenol, plant sterol or stanol (phytosterols and phytostanols), a polyols, a prebiotic, a probiotic, a phytoestrogen, soy protein, sulfides/thiols, amino acids, a protein, a vitamin, a mineral, and/or a substance classified based on a health benefits, such as cardiovascular, cholesterol-reducing or anti-inflammatory.

A composition with a diterpene or diterpene glycoside may include a flavoring agent, an aroma component, a nucleotide, an organic acid, an organic acid salt, an inorganic acid, a bitter compound, a protein or protein hydrolyzate, a surfactant, a flavonoid, an astringent compound, a vitamin, a dietary fiber, an antioxidant, a fatty acid and/or a salt.

A diterpene or diterpene glycoside of the invention may be applied as a high intensity sweetener to produce zero calorie, reduced calorie or diabetic beverages and food products with improved taste characteristics. Also it can be used in drinks, foodstuffs, pharmaceuticals, and other products in which sugar cannot be used.

In addition, a diterpene or diterpene glycoside of the invention may be used as a sweetener not only for drinks, foodstuffs, and other products dedicated for human consumption, but also in animal feed and fodder with improved characteristics.

The examples of products where a diterpene or diterpene glycoside of the invention composition can be used as a sweetening compound can be as alcoholic beverages such as vodka, wine, beer, liquor, sake, etc; natural juices, refreshing drinks, carbonated soft drinks, diet drinks, zero calorie drinks, mid and reduced calorie drinks and foods, yogurt drinks, instant juices, instant coffee, powdered types of instant beverages, canned products, syrups, fermented soybean paste, soy sauce, vinegar, dressings, mayonnaise, ketchups, curry, soup, instant bouillon, powdered soy sauce, powdered vinegar, types of biscuits, rice biscuit, crackers, bread, chocolates, caramel, candy, chewing gum, jelly, pudding, preserved fruits and vegetables, fresh cream, jam, marmalade, flower paste, powdered milk, ice cream, sorbet, vegetables and fruits packed in bottles, canned and boiled beans, meat and foods boiled in sweetened sauce, agricultural vegetable food products, seafood, ham, sausage, fish ham, fish sausage, fish paste, deep fried fish products, dried seafood products, frozen food products, preserved seaweed, preserved meat, tobacco, medicinal products, and many others. In principal it can have unlimited applications.

The sweetened composition comprises a beverage, non-limiting examples of which include non-carbonated and carbonated beverages such as colas, ginger ales, root beers, tonic water, ciders, fruit-flavored soft drinks (e.g., citrus-flavored soft drinks such as lemon-lime or orange), powdered soft drinks, and the like; fruit juices originating in fruits or vegetables, fruit juices including squeezed juices or the like, fruit juices containing fruit particles, fruit beverages, fruit juice beverages, beverages containing fruit juices, beverages with fruit flavorings, vegetable juices, juices containing vegetables, and mixed juices containing fruits and vegetables; sport drinks, energy drinks, near water and the like drinks (e.g., water with natural or synthetic flavorants); tea type or favorite type beverages such as coffee, cocoa, black tea, green tea, oolong tea and the like; beverages containing milk components such as milk beverages, coffee containing milk components, cafe au lait, milk tea, fruit milk beverages, drinkable yogurt, lactic acid bacteria beverages or the like; and dairy products.

Generally, the amount of sweetener present in a sweetened composition varies widely depending on the particular type of sweetened composition and its desired sweetness. Those of ordinary skill in the art can readily discern the appropriate amount of sweetener to put in the sweetened composition.

The diterpene or diterpene glycoside of the invention obtained in this invention can be used in dry or liquid forms. It can be added before or after heat treatment of food products. The amount of the sweetener depends on the purpose of usage. It can be added alone or in the combination with other compounds.

During the manufacturing of foodstuffs, drinks, pharmaceuticals, cosmetics, table top products, chewing gum the conventional methods such as mixing, kneading, dissolution, pickling, permeation, percolation, sprinkling, atomizing, infusing and other methods can be used.

Thus, compositions of the present invention can be made by any method known to those skilled in the art that provide homogenous even or homogeneous mixtures of the ingredients. These methods include dry blending, spray drying, agglomeration, wet granulation, compaction, co-crystallization and the like.

In solid form a diterpene or diterpene glycoside of the invention of the present invention can be provided to consumers in any form suitable for delivery into the comestible to be sweetened, including sachets, packets, bulk bags or boxes, cubes, tablets, mists, or dissolvable strips. The composition can be delivered as a unit dose or in bulk form.

For liquid sweetener systems and compositions convenient ranges of fluid, semi-fluid, paste and cream forms, appropriate packing using appropriate packing material in any shape or form shall be invented which is convenient to carry or dispense or store or transport any combination containing any of the above sweetener products or combination of product produced above.

The composition may include various bulking agents, functional ingredients, colorants, flavors.

A reference herein to a patent document or other matter which is given as prior art is not to be taken as an admission that that document or matter was known or that the information it contains was part of the common general knowledge as at the priority date of any of the claims.

The disclosure of each reference set forth herein is incorporated herein by reference in its entirety.

The present invention is further illustrated by the following Examples:

EXAMPLES

General

Standard genetic techniques, such as overexpression of enzymes in the host cells, as well as for additional genetic modification of host cells, are known methods in the art, such as described in Sambrook and Russel (2001) "Molecular Cloning: A Laboratory Manual ($3^{rd}$ edition), Cold Spring Harbor Laboratory, *Cold Spring Harbor Laboratory Press*, or F. Ausubel et al, eds., "Current protocols in molecular biology", Green Publishing and Wiley Interscience, New York (1987). Methods for transformation and genetic modification of fungal host cells are known from e.g. EP-A-0 635 574, WO 98/46772, WO 99/60102 and WO 00/37671.

A description of the sequences is set out in Table 1. Sequences described herein may be defined with reference to the sequence listing or with reference to the database accession numbers also set out in Table 1.

Example 1. Construction of Steviol Producing Strains of Recombinant *Yarrowia lipolytica*

Figure 2:
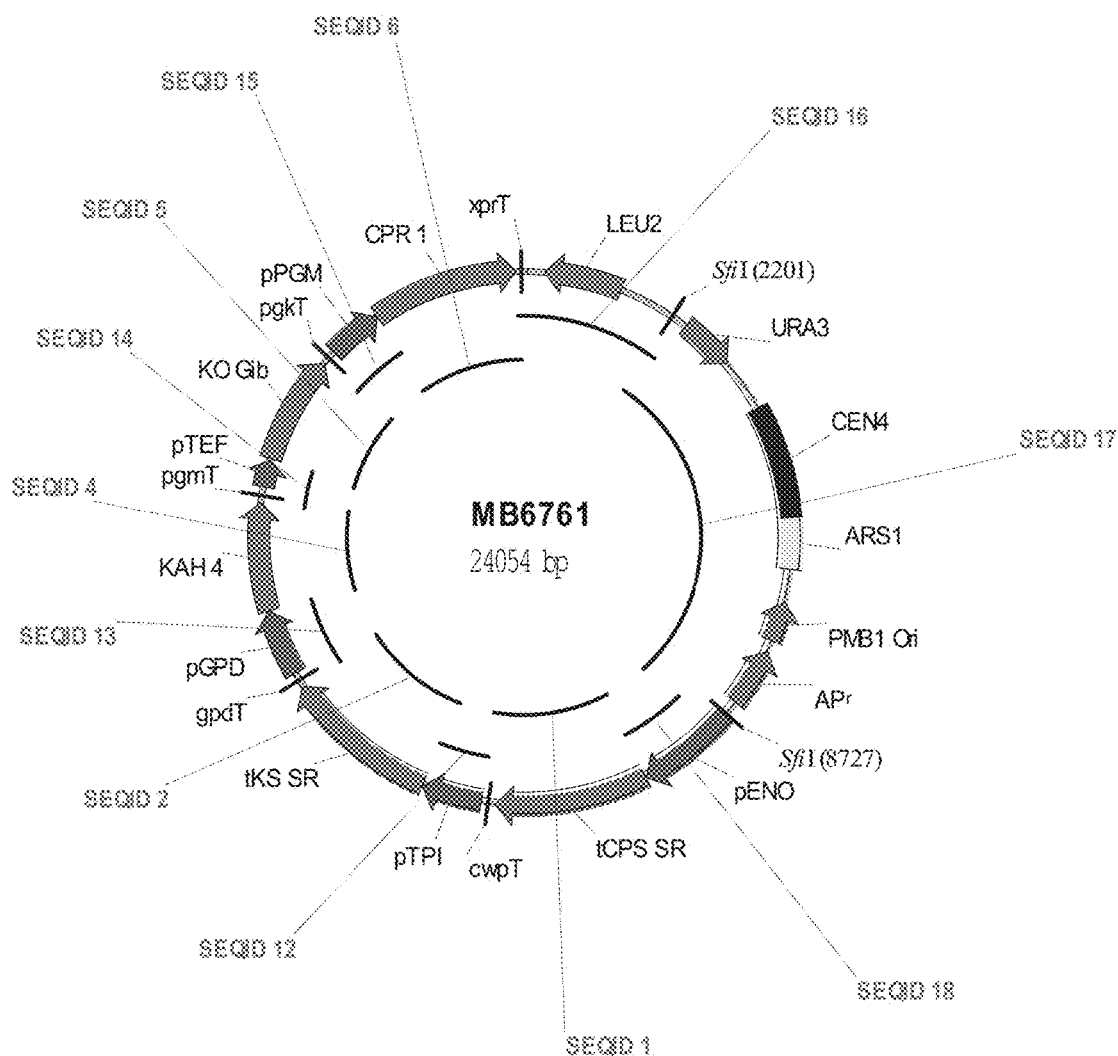
FIG. 2 sets out a schematic representation of the plasmid MB6761.
Figure 3:
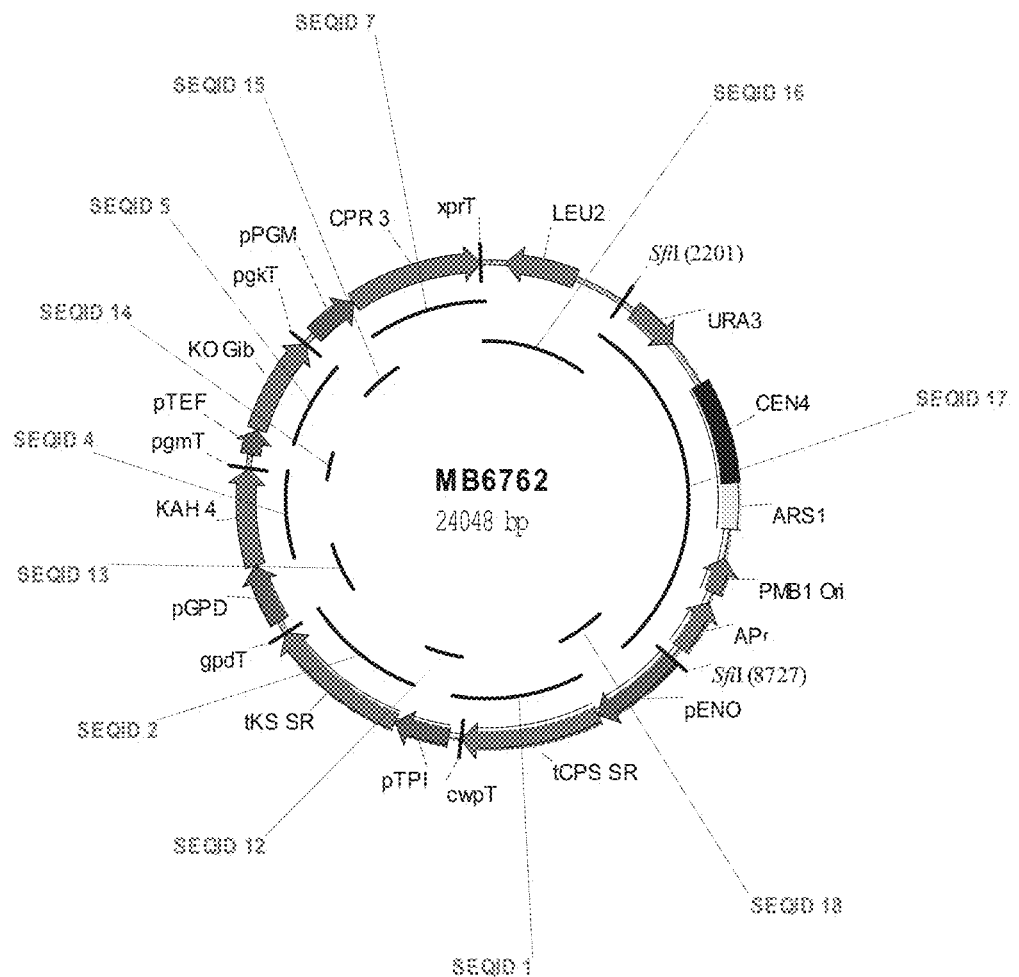
FIG. 3 sets out a schematic representation of the plasmid MB6762.

Plasmids pMB6754, pMB6761, and pMB6762 (see Table 1 and FIGS. 1, 2 and 3) encoding genes for the synthesis of steviol were constructed as follows. Open reading frames for tCPS (SEQ ID NO: 182), tKS (SEQ ID NO: 183), CPSKS (SEQ ID NO: 184), KOGib (SEQ ID NO: 186), KAH4 (SEQ ID NO: 185), CPR1 (SEQ ID NO: 187) and CPR3 (SEQ ID NO: 188) were codon pair optimized using codon pair optimisation technology as disclosed in PCT/EP2007/05594, for expression in *Yarrowia lipolytica*.

The optimized sequences, flanked by 60 bp of the desired promoter and terminator, were synthesized by GenScript (SEQ ID NOS: 182-188), and amplified by PCR using appropriate primers. DNA fragments encoding terminator-promoter sequences, TPI promoter, or *Yarrowia lipolytica* markers were amplified by PCR from existing constructs (SEQID 193-197 and 199). Vector DNA (SEQID 198), consisting of the *S. cerevisiae* centromere-based URA3 plasmid YCp50 (Rose et al., Gene 1987; 60(2-3):237-43) with ENOp from *Yarrowia* replacing the tet gene using standard techniques, was prepared from *E. coli* and digested with XbaI and SnaBI. All fragments were purified by gel electrophoresis using a QiaQuick kit (Qiagen). *S. cerevisiae* strain 10556-23C (W303 background; G. R. Fink) was transformed (Gietz and Schiestl, Nat. Protoc. 2007; 2(1): 31-4) with 250 ng of each DNA fragment and selected for prototrophy on minimal glucose aspartate medium. Plasmids were rescued from prototrophic transformants (Nucleic Acids Research, Vol. 20, No. 14, p. 3790 (1992)) and used to transform *E. coli* DH5α to ampicillin resistance (100 mg/L) on LB agar plates.

*Yarrowia* strain ML2597 with increased expression of geranylgeranyl diphosphate synthase was obtained by transformation of MF350 with pMB4591 (tef1-GGS URA2) (U.S. Pat. No. 7,851,199). Plasmids pMB6754, pMB6761, and pMB6762 were digested with SfiI and used to transform ML2597 to leucine prototrophy on minimal glucose aspartate medium containing adenine (0.2 mM). Transformants were restreaked to selective medium and subsequently inoculated to 0.8 ml YPD in 24 well microtiter plates (MTP).

Plates were sealed with a BugStopper mat (Whatman) and strains were grown for steviol production at 30° C. with shaking at 800 rpm for six days in a Multitron incubator (Infors)—see Table 2.

TABLE 1

Steviol & RebA pathway plasmids

| Plasmid | SEQIDs | Genotype (partial) |
| --- | --- | --- |
| pMB6754 | 184, 185, 186, 187, 194, 195, 196, 197, 198, 199 | CPSKS, KAH_4, KO_Gib, CPR_1, LEU2 |
| pMB6761 | 184, 185, 186, 188, 194, 195, 196, 197, 198, 199 | tCPS, tKS, KAH_4, KO_Gib, CPR_1, LEU2 |
| pMB6762 | 182, 183, 185, 186, 188, 193, 194, 195, 196, 197, 198, 199 | tCPS, tKS, KAH_4, KO_Gib, CPR_3, LEU2 |
| pMB6775 | 189, 190, 191, 192, 194, 195, 196, 198, 199, 200 | UGT1, UGT3, UGT4, UGT2, HPH |

TABLE 2

Steviol production strains

| Strain | Plasmid |
| --- | --- |
| ML12925 | pMB6754 |
| ML12927 | pMB6754 |
| ML12929 | pMB6162 |
| ML12930 | pMB6162 |
| ML12931 | pMB6761 |
| ML12932 | pMB6761 |

Example 2. Construction of RebA Producing Strains of Recombinant *Yarrowia lipolytica*

Figure 4:
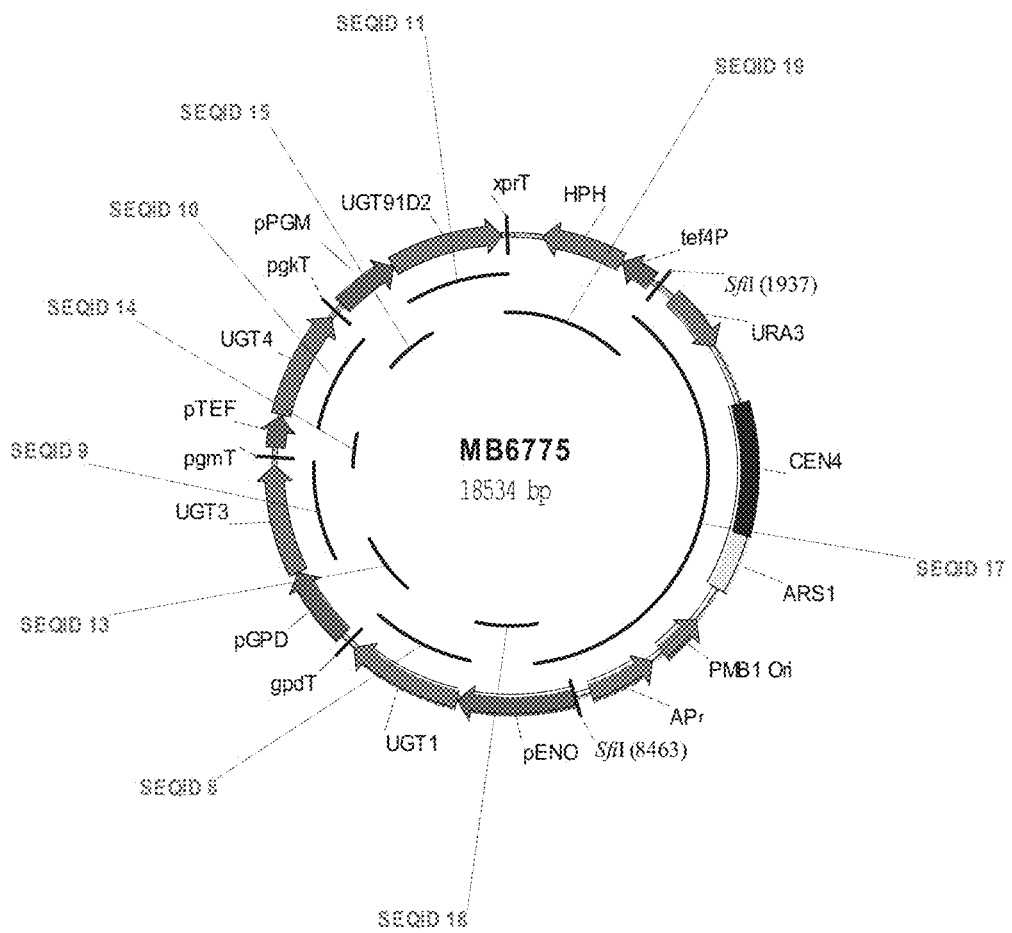
FIG. 4 sets out a schematic representation of the plasmid MB6775.

Plasmid pMB6775 (see Table 1 and FIG. 4) encoding genes for the synthesis of RebA was constructed as follows. Open reading frames for a UGT1, UGT3, UGT4, and UGT2 were codon pair optimized using codon pair optimisation technology as disclosed in PCT/EP2007/05594, for expression in *Yarrowia lipolytica*. The optimized sequences, flanked by 60 bp of the desired promoter and terminator, were synthesized by GenScript (SEQ ID NOs 189-192), and amplified by PCR using appropriate primers. DNA fragments encoding terminator-promoter sequences or *Yarrowia lipolytica* markers were amplified by PCR from existing constructs (SEQ ID NOS: 194-196, 199 and 200). The vector (SEQ ID NO: 198), consisting of the *S. cerevisiae* centromere-based URA3 plasmid YCp50 (Rose et al., supra) with ENOp from *Yarrowia* replacing the tet gene using standard techniques, was prepared from *E. coli* and digested with XbaI and SnaBI. All fragments were purified by gel electrophoresis using a QiaQuick kit (Qiagen). *S. cerevisiae* strain 10556-23C (W303 background; G. R. Fink) was transformed (Gietz and Schistl, supra) with 250 ng of each DNA fragment and selected for prototrophy on minimal glucose aspartate medium. Plasmids were rescued from prototrophic transformants (Nucleic Acids Research, Vol. 20, No. 14, p. 3790 (1992)) and used to transform *E. coli* DH5α to ampicillin resistance (100 mg/L) on LB agar plates.

Plasmid MB6775 was digested with SfiI and used to transform Steviol producing *Yarrowia* strains ML12925, ML12929, and ML12931 to hygromycin resistance (100 mg/L) on YPD agar plates. Transformants were restreaked to selective medium and subsequently inoculated to 0.8 ml YPD in 24 well microtiter plates (MTP). Plates were sealed with a BugStopper mat (Whatman) and strains are grown for steviol production at 30° C. with shaking at 800 rpm for six days in a Multitron incubator (Infors).

A RebA producing transformant of ML12929 was denoted ML12986 Protrophic strains were generated from ML12986 in one of two ways. ML12986 was transformed to prototrophy with Haelli digested pMP4637 (WO2006/102342) on YNB plates, yielding strain ML12987. Alternately, ML12986 was mated to ML5929. ML5929 {MATA ura2 ADE1-tHMG LEU2-CarRP} was constructed by the introduction of heterologous genes under the control of the endogenous TEF1 promoter, coupled with several generations of crossbreeding. Protrophic spores were screened for RebA production, resulting in the isolation of ML13113.

Example 3. Production of RebA by *Yarrowia*

The *Y. lipolytica* strain ML13113 constructed as described above, was cultivated in shake-flasks (2 l with 200 ml medium) for 1 days at 30° C. and 200 rpm. The medium was based on Verduyn et al. (Verduyn C, Postma E, Scheffers W A, Van Dijken J P. Yeast, 1992 July; 8(7):501-517), with modifications in the carbon and nitrogen sources, as described in Tables 12 and 13.

TABLE 13

Preculture medium composition *Y. lipolytica* strain ML13113

| Raw material | Formula | Concentraion (g/kg) |
| --- | --- | --- |
| Glucose•1aq | $C_6H_{12}O_6$•$1H_2O$ | 22.0 |
| Urea | $(NH_2)_2CO$ | 2.3 |
| Potassium dihydrogen phosphate | $KH_2PO_4$ | 3.0 |
| Magnesium sulphate | $MgSO_4$•$7H_2O$ | 0.5 |
| Trace element solution | | 1 |
| Vitamin solution | | 1 |

| Component | Formula | Concentraion (g/kg) |
| --- | --- | --- |
| [a]Trace elements solution | | |
| EDTA | $C_{10}H_{14}N_2Na_2O_8$•$2H_2O$ | 15.00 |
| Zincsulphate•$7H_2O$ | $ZnSO_4$•$7H_2O$ | 4.50 |
| Manganesechloride•$2H_2O$ | $MnCl_2$•$2H_2O$ | 0.84 |
| Cobalt (II) chloride•$6H_2O$ | $CoCl_2$•$6H_2O$ | 0.30 |
| Cupper (II) sulphate•$5H_2O$ | $CuSO_4$•$5H_2O$ | 0.30 |
| Sodium molybdenum•$2H_2O$ | $Na_2MoO_4$•$2H_2O$ | 0.40 |
| Calciumchloride•$2H_2O$ | $CaCl_2$•$2H_2O$ | 4.50 |
| Ironsulphate•$7H_2O$ | $FeSO_4$•$7H_2O$ | 3.00 |
| Boric acid | $H_3BO_3$ | 1.00 |
| Potassium iodide | KI | 0.10 |
| [b]Vitamin solution | | |
| Biotin (D−) | $C_{10}H_{16}N_2O_3S$ | 0.05 |
| Ca D(+) panthothenate | $C_{18}H_{32}CaN_2O_{10}$ | 1.00 |
| Nicotinic acid | $C_6H_5NO_2$ | 1.00 |
| Myo-inositol | $C_6H_{12}O_6$ | 25.00 |
| Thiamine chloride hydrochloride | $C_{12}H_{18}Cl_2N_4OS$•$xH_2O$ | 1.00 |
| Pyridoxol hydrochloride | $C_8H_{12}ClNO_3$ | 1.00 |
| p-aminobenzoic acid | $C_7H_7NO_2$ | 0.20 |

Subsequently, 12 ml of the content of the shake-flask was transferred into a fermenter (starting volume 0.3 L) for *Y. lipolytica* strain ML13113, which contained the medium as set out in Table 14.

TABLE 14

Composition fermentaion medium

| Raw material | Formula | Final Concentraion (g/kg) |
|---|---|---|
| Glucose•1aq | $C_6H_{12}O_6 \cdot 1H_2O$ | 4.4 |
| Ammonium sulphate | $(NH_4)_2SO_4$ | 1 |
| Potassium dihydrogen phosphate | $KH_2PO_4$ | 10 |
| Magnesium sulphate | $MgSO_4 \cdot 7H_2O$ | 5 |
| Trace element solution | — | 8 |
| Vitamin solution | — | 8 |

The pH was controlled at 5.0 by addition of ammonia (10 wt %). Temperature was controlled at 27° C. for *Y. lipolytica* strain ML13113. $pO_2$ was controlled at 40% by adjusting the stirrer speed. Glucose concentration was kept limited by controlled feed to the fermenter as set out in Table 15.

TABLE 15

Composition of the fermentation feed medium

| Raw material | Formula | Final Concentraion (g/kg) |
|---|---|---|
| Glucose•1aq | $C_6H_{12}O_6 \cdot 1H_2O$ | 550 |
| Potassium dihydrogen phosphate | $KH_2PO_4$ | 15.1 |
| Magnesium sulphate heptahydrate | $MgSO_4 \cdot 7H_2O$ | 7.5 |
| Verduyn trace elements solution | | 12 |
| Verduyn vitamin solution | | 12 |

A whole broth sample was washed twice with physiologic salt solution containing 8.5 g/l NaCl. The RebA concentration in whole broth and washed broth show that for the *Y. lipolytica* strain 93% of the RebA can be removed by washing.

TABLE 16

RebA in whole broth and washed broth.

| Strain | Time [h] | RebA [g/l] Supernatant | RebA [g/l] Whole Broth | RebA [g/l] Washed Broth | RebA removed by washing [-] |
|---|---|---|---|---|---|
| ML13113 | 117 | 0.46 | 0.38 | 0.02 | 93% |

Example 4. Effect of Temperature on the Production of RebA by *Yarrowia*

The *Y. lipolytica* strain ML13113 constructed as described above, was cultivated in shake-flask (2 l with 200 ml medium) for 1 days at 30° C. and 200 rpm. The medium was based on Verduyn et al. (Verduyn C, Postma E, Scheffers W A, Van Dijken J P. Yeast, 1992 July; 8(7):501-517), with modifications in the carbon and nitrogen source, as described in Table 17.

TABLE 17

Preculture medium composition *Y. lipolytica* strain ML13113

| Raw material | Formula | Concentraion (g/kg) |
|---|---|---|
| Glucose•1aq | $C_6H_{12}O_6 \cdot 1H_2O$ | 22.0 |
| Urea | $(NH_2)_2CO$ | 2.3 |
| Potassium dihydrogen phosphate | $KH_2PO_4$ | 3.0 |
| Magnesium sulphate | $MgSO_4 \cdot 7H_2O$ | 0.5 |
| Trace element solution | | 1 |
| Vitamin solution | | 1 |

| Component | Formula | Concentraion (g/kg) |
|---|---|---|
| *Trace elements solution* | | |
| EDTA | $C_{10}H_{14}N_2Na_2O_8 \cdot 2H_2O$ | 15.00 |
| Zincsulphate•7H2O | $ZnSO_4 \cdot 7H_2O$ | 4.50 |
| Manganesechloride•2H2O | $MnCl_2 \cdot 2H_2O$ | 0.84 |
| Cobalt (II) chloride•6H2O | $CoCl_2 \cdot 6H_2O$ | 0.30 |
| Cupper (II) sulphate•5H2O | $CuSO_4 \cdot 5H_2O$ | 0.30 |
| Sodium molybdenum•2H2O | $Na_2MoO_4 \cdot 2H_2O$ | 0.40 |
| Calciumchloride•2H2O | $CaCl_2 \cdot 2H_2O$ | 4.50 |
| Ironsulphate•7H2O | $FeSO_4 \cdot 7H_2O$ | 3.00 |
| Boric acid | $H_3BO_3$ | 1.00 |
| Potassium iodide | KI | 0.10 |
| *Vitamin solution* | | |
| Biotin (D-) | $C_{10}H_{16}N_2O_3S$ | 0.05 |
| Ca D(+) panthothenate | $C_{18}H_{32}CaN_2O_{10}$ | 1.00 |
| Nicotinic acid | $C_6H_5NO_2$ | 1.00 |
| Myo-inositol | $C_6H_{12}O_6$ | 25.00 |
| Thiamine chloride hydrochloride | $C_{12}H_{18}Cl_2N_4OS \cdot xH_2O$ | 1.00 |
| Pyridoxol hydrochloride | $C_8H_{12}ClNO_3$ | 1.00 |
| p-aminobenzoic acid | $C_7H_7NO_2$ | 0.20 |

Subsequently, 12 ml of the content of the shake-flask was transferred into a fermenter (starting volume 0.3 L), which contained the medium as set out in Table 18.

TABLE 18

Composition fermentation medium

| Raw Material | Formula | Final Concentraion (g/kg) |
|---|---|---|
| Glucose•1aq | $C_6H_{12}O_6 \cdot 1H_2O$ | 4.4 |
| Ammonium sulphate | $(NH_4)_2SO_4$ | 1 |
| Potassium dihydrogen phosphate | $KH_2PO_4$ | 10 |
| Magnesium sulphate | $MgSO_4 \cdot 7H_2O$ | 5 |
| Trace element solution | — | 8 |
| Vitamin solution | — | 8 |

The pH was controlled at 5.0 by addition of ammonia (10 wt %). Temperature was controlled at 26° C., 28° C., 30° C., 32° C. $pO_2$ was controlled at 40% by adjusting the stirrer speed. Glucose concentration was kept limited by controlled feed to the fermenter (Table 19).

TABLE 19

Composition of the fermentation feed medium

| Raw Material | Formula | Final Concentraion (g/kg) |
|---|---|---|
| Glucose•1aq | $C_6H_{12}O_6 \cdot 1H_2O$ | 550 |
| Potassium dihydrogen phosphate | $KH_2PO_4$ | 15.1 |
| Magnesium sulphate heptahydrate | $MgSO_4 \cdot 7H_2O$ | 7.5 |
| Verduyn trace elements solution | | 12 |
| Verduyn vitamin solution | | 12 |

The results set out in Table 20 show that the production of RebA by recombinant *Yarrowia lipolytica* increases as the fermentation temperature is increased.

TABLE 20

Concentration of RebA present in pellet at 117 hours at different operating temperatures

| Temperature (° C.) | RebA broth (g/l) | RebA sup (g/l) |
|---|---|---|
| 26 | 0.37 | 0.27 |
| 28 | 0.46 | 0.38 |
| 30 | 0.62 | 0.47 |
| 32 | 0.66 | 0.53 |

TABLE 1

Description of the sequence listing

| Nucleic acid (CpO for S. cerevisiae) | Nucleic acid (CpO for Y. lipolytica) | Amino acid | Id* | UniProt | Organism |
|---|---|---|---|---|---|
| SEQ ID NO: 1 | SEQ ID NO: 151 | SEQ ID NO: 2 | CPS_1 | Q9FXV9 | Lactuca sativa (Garden Lettuce) |
| SEQ ID NO: 3 | SEQ ID NO: 152 | SEQ ID NO: 4 | tCPS_1 |  | Lactuca sativa (Garden Lettuce) |
| SEQ ID NO: 5 | SEQ ID NO: 153 | SEQ ID NO: 6 | CPS_2 | D2X8G0 | Picea glauca |
| SEQ ID NO: 7 | SEQ ID NO: 154 | SEQ ID NO: 8 | CPS_3 | Q45221 | Bradyrhizobium japonicum |
| SEQ ID NO: 9 | SEQ ID NO: 155 | SEQ ID NO: 10 | KS_1 | Q9FXV8 | Lactuca sativa (Garden Lettuce) |
| SEQ ID NO: 11 | SEQ ID NO: 156 | SEQ ID NO: 12 | tKS_1 |  | Lactuca sativa (Garden Lettuce) |
| SEQ ID NO: 13 | SEQ ID NO: 157 | SEQ ID NO: 14 | KS_2 | D2X8G1 | Picea glauca |
| SEQ ID NO: 15 | SEQ ID NO: 158 | SEQ ID NO: 16 | KS_3 | Q45222 | Bradyrhizobium japonicum |
| SEQ ID NO: 17 | SEQ ID NO: 159 | SEQ ID NO: 18 | CPSKS_1 | O13284 | Phaeosphaeria sp |
| SEQ ID NO: 19 | SEQ ID NO: 160 | SEQ ID NO: 20 | CPSKS_2 | Q9UVY5 | Gibberella fujikuroi |
| SEQ ID NO: 21 | SEQ ID NO: 161 | SEQ ID NO: 22 | KO_1 | B5MEX5 | Lactuca sativa (Garden Lettuce) |
| SEQ ID NO: 23 | SEQ ID NO: 162 | SEQ ID NO: 24 | KO_2 | B5MEX6 | Lactuca sativa (Garden Lettuce) |
| SEQ ID NO: 25 | SEQ ID NO: 163 | SEQ ID NO: 26 | KO_3 | B5DBY4 | Sphaceloma manihoticola |
| SEQ ID NO: 27 | SEQ ID NO: 164 | SEQ ID NO: 28 | KAH_1 | Q2HYU7 | Artemisia annua (Sweet wormwood). |
| SEQ ID NO: 29 | SEQ ID NO: 165 | SEQ ID NO: 30 | KAH_2 | B9SBP0 | Ricinus communis (Castor bean). |
| SEQ ID NO: 31 | SEQ ID NO: 166 | SEQ ID NO:32 | KAH_3 | Q0NZP1 | Stevia rebaudiana |
| SEQ ID NO: 33 | SEQ ID NO: 167 | SEQ ID NO: 34 | KAH_4 | JP2009065886 | Arabidopsis thaliana (Mouse-ear cress) |
| SEQ ID NO: 35 | SEQ ID NO: 168 | SEQ ID NO: 36 | UGT1_1 | A9X3L6 | Ixeris dentata var. albiflora. |
| SEQ ID NO: 37 | SEQ ID NO: 169 | SEQ ID NO: 38 | UGT1_2 | B9SIN2 | Ricinus communis (Castor bean). |
| SEQ ID NO: 39 | SEQ ID NO: 170 | SEQ ID NO: 40 | UGT3_1 | A9X3L7 | Ixeris dentata var. Albifiora |
| SEQ ID NO: 41 | SEQ ID NO: 171 | SEQ ID NO: 42 | UGT3_2 | B9IEM5 | Populus trichocarpa (Western balsam poplar) |
| SEQ ID NO: 43 | SEQ ID NO: 172 | SEQ ID NO:44 | UGT3_3 | Q9M6E7 | Nicotiana tabacum |
| SEQ ID NO: 45 | SEQ ID NO: 173 | SEQ ID NO:46 | UGT3_4 | A3E7Y9 | Vaccaria hispanica |
| SEQ ID NO: 47 | SEQ ID NO: 174 | SEQ ID NO: 48 | UGT3_5 | P10249 | Streptococcus mutans |
| SEQ ID NO: 49 | SEQ ID NO: 175 | SEQ ID NO: 50 | UGT4_1 | A4F1T4 | Lobelia erinus (Edging lobelia) |
| SEQ ID NO: 51 | SEQ ID NO: 176 | SEQ ID NO: 52 | UGT4_2 | Q9M052 | Arabidopsis thaliana (Mouse-ear cress) |
| SEQ ID NO: 53 | SEQ ID NO: 177 | SEQ ID NO: 54 | CPR_1 | Q7Z8R1 | Gibberella fujikuroi |
| SEQ ID NO: 55 | SEQ ID NO: 178 | SEQ ID NO: 56 | CPR_2 | Q9SB48 | Arabidopsis thaliana (Mouse-ear cress) |
| SEQ ID NO: 57 | SEQ ID NO: 179 | SEQ ID NO: 58 | CPR_3 | Q9SUM3 | Arabidopsis thaliana (Mouse-ear cress) |
| SEQ ID NO: 59 | SEQ ID NO: 141 | SEQ ID NO: 60 | CPS_SR | O22667 | Stevia rebaudiana |

TABLE 1-continued

Description of the sequence listing

| Nucleic acid (CpO for *S. cerevisiae*) | Nucleic acid (CpO for *Y. lipolytica*) | Amino acid | Id* | UniProt | Organism |
|---|---|---|---|---|---|
| SEQ ID NO: 61 | SEQ ID NO: 142 | SEQ ID NO: 62 | tCPS_SR | Q22667 | *Stevia rebaudiana* |
| SEQ ID NO: 63 | SEQ ID NO: 143 | SEQ ID NO: 64 | KS_SR | Q9XEI0 | *Stevia rebaudiana* |
| SEQ ID NO: 65 | SEQ ID NO: 144 | SEQ ID NO: 66 | tKS_SR | Q9XEI0 | *Stevia rebaudiana* |
| SEQ ID NO: 67 | SEQ ID NO: 145 | SEQ ID NO: 68 | KO_SR | Q4VCL5 | *Stevia rebaudiana* |
| SEQ ID NO: 69 | SEQ ID NO: 146 | SEQ ID NO: 70 | KAH_SR | A0A251TSS1 | *Stevia rebaudiana* |
| SEQ ID NO: 71 | SEQ ID NO: 147 | SEQ ID NO: 72 | UGT1_SR | Q6VAB0 | *Stevia rebaudiana* |
| SEQ ID NO: 73 | SEQ ID NO: 148 | SEQ ID NO:74 | UGT3_SR | Q6VAA6 | *Stevia rebaudiana* |
| SEQ ID NO: 75 | SEQ ID NO: 149 | SEQ ID NO: 76 | UGT4_SR | Q6VAB4 | *Stevia rebaudiana* |
| SEQ ID NO: 77 | SEQ ID NO: 150 | SEQ ID NO: 78 | CPR_SR | Q2I6J8 | *Stevia rebaudiana* |
| SEQ ID NO: 79 | | SEQ ID NO: 80 | tHMG1 | G2WJY0 | *Saccharomyces cerevisiae* |
| SEQ ID NO: 81 | | SEQ ID NO: 82 | ERG20 | E7LW73 | *Saccharomyces cerevisiae* |
| SEQ ID NO: 83 | | SEQ ID NO: 84 | BTS1 | E7Q9V5 | *Saccharomyces cerevisiae* |
| SEQ ID NO: 85 | SEQ ID NO: 180 | SEQ ID NO: 86 | KO_Gibfu | O94142 | *Gibberella fujikuroi* |
| SEQ ID NO: 87 | SEQ ID NO: 181 | SEQ ID NO: 88 | UGT2_1a | B3VI56 | *Stevia rebaudiana* |
| SEQ ID NO: 89 | | SEQ ID NO: 90 | KAH_ASR1 | Xxx | *S. rebaudiana* |
| SEQ ID NO: 91 | | SEQ ID NO: 92 | KAH_ASR2 | Q0NZP1_STERE | *S. rebaudiana* |
| SEQ ID NO: 93 | | SEQ ID NO: 94 | KAH_AAT | Q6NKZ8_ARATH | *A. thaliana* |
| SEQ ID NO: 95 | | SEQ ID NO: 96 | KAH_AW | F6H190_VITVI | *Vitis vinifera* |
| SEQ ID NO: 97 | | SEQ ID NO: 98 | KAH_AMT | Q2MJ20_MEDTR | *Medicago truncatula* |
| SEQ ID NO: 99 | | SEQ ID NO: 100 | UGT2_1b | B3VI56 | *S. rebaudiana* |
| SEQ ID NO: 101 | | SEQ ID NO: 102 | UGT2_2 | Q53UHS_IPOPU | *I. purpurea* |
| SEQ ID NO: 103 | | NO: 104 | UGT2_3 | UGIA1_BELPE | *Bellis perennis* |
| SEQ ID NO: 05 | | SEQ ID NO: 106 | UGT2_4 | B3VI56 | *S. rebaudiana* |
| SEQ ID NO: 107 | | SEQ ID NO: 108 | UGT2_5 | Q6VAA8 | *S. rebaudiana* |
| SEQ ID NO: 109 | | SEQ ID NO: 110 | UGT2_6 | Q8LKG3 | *S. rebaudiana* |
| SEQ ID NO: 111 | | SEQ ID NO: 112 | UGT2_7 | B9HSH7_POPTR | *Populus trichocarpa* |
| SEQ ID NO: 113 | | SEQ ID NO: 114 | UGT_RD1 | Q6VAA3 | *S. rebaudiana* |
| SEQ ID NO: 115 | | SEQ ID NO: 116 | UGT_RD2 | Q8H6A4 | *S. rebaudiana* |
| SEQ ID NO: 117 | | SEQ ID NO: 118 | UGT_RD3 | Q6VAA4 | *S. rebaudiana* |
| SEQ ID NO: 119 | | SEQ ID NO: 120 | UGT_RD4 | Q6VAA5 | *S. rebaudiana* |
| SEQ ID NO: 121 | | SEQ ID NO: 122 | UGT_RD5 | Q6VAA7 | *S. rebaudiana* |
| SEQ ID NO: 123 | | SEQ ID NO: 124 | UGT_RD6 | Q6VAA8 | *S. rebaudiana* |
| SEQ ID NO: 125 | | SEQ ID NO: 126 | UGT_RD7 | Q6VAA9 | *S. rebaudiana* |
| SEQ ID NO: 127 | | SEQ ID NO: 128 | UGT_RD8 | Q6VAB1 | *S. rebaudiana* |
| SEQ ID NO: 129 | | SEQ ID NO: 130 | UGT_RD9 | Q6VAB2 | *S. rebaudiana* |

TABLE 1-continued

Description of the sequence listing

| Nucleic acid (CpO for S. cerevisiae) | Nucleic acid (CpO for Y. lipolytica) | Amino acid | Id* | UniProt | Organism |
|---|---|---|---|---|---|
| SEQ ID NO: 131 | SEQ ID NO: 132 | | UGT_RD10 | Q6VAB3 | S. rebaudiana |
| SEQ ID NO: 133 | SEQ ID NO: 134 | | UGT_RD11 | B9VVB1 | S. rebaudiana |
| SEQ ID NO: 135 | SEQ ID NO: 136 | | UGT_RD12 | C7EA09 | S. rebaudiana |
| SEQ ID NO: 137 | 5E0 ID NO: 138 | | UGT_RD13 | Q8LKG3 | S. rebaudiana |
| SEQ ID NO: 139 | SEQ ID NO: 140 | | UGT_RD14 | B3VI56 | S. rebaudiana |
| | | SEQ ID NO: 182 | tCPS | | |
| | | SEQ ID NO: 183 | tKS | | |
| | | SEQ ID NO: 184 | CPSKS | | |
| | | SEQ ID NO: 185 | KAH4 | | |
| | | SEQ ID NO: 186 | KO_Gibfu | | |
| | | SEQ ID NO: 187 | CPR1 | | |
| | | SEQ ID NO: 188 | CPR3 | | |
| | | SEQ ID NO: 189 | UGT1 | | |
| | | SEQ ID NO: 190 | UGT3 | | |
| | | SEQ ID NO: 191 | UGT4 | | |
| | | SEQ ID NO: 192 | UGT2_1a | | |
| | | SEQ ID NO: 193 | pTPI | | |
| | | SEQ ID NO: 194 | gpdT-pGPD | | |
| | | SEQ ID NO: 195 | pgmT-pTEF | | |
| | | SEQ ID NO: 196 | pgkT-pPGM | | |
| | | SEQ ID NO: 197 | LEU2 and flanking sequences | | |
| | | SEQ ID NO: 198 | vector sequences | | |
| | | SEQ ID NO: 199 | pENO | | |
| | | SEQ ID NO: 200 | HPH | | |
| SEQ ID NO: 201 | | | Sc Eno2.pro | | |
| SEQ ID NO: 202 | | | Sc Fba1.pro | | |
| SEQ ID NO: 203 | | | Sc Tef1.pro | | |
| SEQ ID NO: 204 | | | Sc Pgk1.pro | | |
| SEQ ID NO: 205 | | | Kl prom 12.pro | | |
| SEQ ID NO: 206 | | | Ag lox_TEF1.pro | | |
| SEQ ID NO: 207 | | | Kl prom 6.pro | | |
| SEQ ID NO: 208 | | | Sc Pma1.pro | | |
| SEQ ID NO: 209 | | | Sc Vps68.pro | | |
| SEQ ID NO:: 210 | | | Sc Oye2.pro | | |
| SEQ ID NO: 211 | | | KANMX ORF | | |
| SEQ ID NO: 212 | | | Adh1.ter | | |

TABLE 1-continued

Description of the sequence listing

| Nucleic acid (CpO for S. cerevisiae) | Nucleic acid (CpO for Y. lipolytica) | Amino acid | Id* | UniProt | Organism |
|---|---|---|---|---|---|
| SEQ ID NO: 213 | | | Adh2.ter | | |
| SEQ ID NO: 214 | | | Gmp1.ter | | |
| SEQ ID NO: 215 | | | Sc Tal1.ter | | |
| SEQ ID NO: 216 | | | Sc Tpi1.ter | | |
| SEQ ID NO: 217 | | | Ag Tef1_lox.ter | | |
| SEQ ID NO: 218 | | | Sc Pdc1.ter | | |
| SEQ ID NO: 219 | | | Sc Tdh1.ter | | |
| SEQ ID NO: 220 | | | Sc Eno1.ter | | |
| SEQ ID NO: 221 | | | KI prom3.pro | | |
| SEQ ID NO: 222 | | | KI prom2.pro | | |
| SEQ ID NO: 223 | | | Sc PRE3. Pro | | | greyed out ids are truncated and thus a fragment of mentioned UniProt id

SEQUENCE LISTING (223 sequences)

SEQ ID NO: 1 - DNA, 2397 bp, Lactuca sativa
  CDS (1)..(2397)
atgaaaaccatgatttcttctccaatcccagctttccacccaagattttctccagctgctggttccagaagattatctccaatcttgccatcttccggttctgttgtcttgactggttccaagactcaatgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 2 - protein, 799 aa, Lactuca sativa
MKTMISSPIPAFHPRFSPAAGSRRLSPILPSSGSVVLTGSKTQCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 3 - DNA, 2271 bp, Lactuca sativa
  CDS (1)..(2271)
atgtgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 4 - protein, 757 aa, Lactuca sativa
MCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 5 - DNA, 2283 bp, Picea glauca
  CDS (1)..(2283)
atgaagatgtccaagtctgttgaagtccaacactgtgctgtccaattcttgtcttccaccaccgatcaaatcgaaatcagagaaagaaacttgcaaatctccactgaagccatgaagatgaaatcctggattgaaaccgtcaaatacattttgcaatccatggaagatggtgaaatcaccatctccgcttacgacactgcttggatcgccttggttccagctttgaacggttcctctgaacctcaattcccatcctctttacaatggttgatcaacaaccaattgcaagacggttcctggggtgacccattgatgttcttgattagagatcgtatcatcaacactttggcttgtgttttggctttgaagacctggaacattcactctttgggtgttaacaagggtctatctttcttgcaaacttacatccctaaaatgaacgatgaacatgatgctcacactccagttggtttcgaaattgtcttcccagctttgatggaagatgccaagatcatggaattggacttgccatacgacgctgaattcttgcaaaagatttacgatgaaagagatttgaagatgaagagaatcccaatgaaggttttgcacgaattcccatctactttattgcactccttggaaggtttgagagacaaggtcaactgggaagaattattgaagttgcaatccaagaacggttctttcttattctctccagcttctactgcttgtgctttggctcaaacttctgacaccaactgtttgagatacttgaatgaaatcaccaagaaatacgacggtggtgctccaaatgtttacccagtcgacttgttcgaaagattatggaccgtcgatcgtattgaaagattaggtattgctagatactttgaatctgaaatcactgactctttggaatacgtttacagatactggactaaccaaggtatcggttgggctagagattctccagttaaggacgtcgatgacacttccatggctttcagactattacgttcccacggtttcgacgttactgctgaagctttcaaccacttcaagcaagatgaccaattcttctgtttctttggtcaaaccaagcaaaccgtcactggtatgtacaacttgtacagagcttctcaattctccttcccaggtgaatctatcttagaagaagctcgtgtcttcaccaagaacttcttggaagaaaagagagctgaaaagcaattgagagacaaatggatcattgctaaaggtttgaaggaagaagtcgaatacgctttgaagttcccatggtatgcctcccaaccaagaattgacaccagaatgtacatcaaccaatacagagttgatgacgtctggatcggtaaggctctatacagaatgccaattgtcaacaacaagacctacatcgaattggccaaggctgacttcaacatttgtcaatctatccacagaactgaattgcacggtatcatcagatggtacagagaatccggtttggacgaattgggtttgagacaagaccaaatcgtcaaatcttacttcttggctgccattgctatctacgaaccagacatggcctctgccagattagcttgggctaagtctgctgtcttgatggctgctatcagaatcttcttttccggtgaaaactgttttgcccaccatagaagacaattcttggatgcctttaccagatgggacggtagagccatgagagattctccaaactccgctaagagattattctcttgtttattcagaatggttaacttgttctctgtcgacggtgttgttgctcaaggtagagacatctccggtgacttgagacacagatgggaacactggttggcctctgaagctgaagacttgaccgatgctcaagaccacgaaaagttgggtactgaagctgaaattgttgttttgactgctgctttcttgggtagagaaaccatttctccagatttgatttctcacccagatttctcttctattatgaaggttaccaacactgtttgttctttattgagaagaattgccacctacaaggaagaaggttgtgactccccatctggtactgaagaagatgacagattgaaacgtcgtgctgaagaaggtatgggtcatttggttcgtgccgtttacagacaccaatactctccagttccatctggtgtcaagagattgtgtttggttgttggtaagtccttttactacgctgctcactgtaacaatgaagaagttggtaaccatgtcgaaaccgtcttgttccaaccagtatac

SEQ ID NO: 6 - protein, 761 aa, Picea glauca
MKMSKSVEVQHCAVQFLSSTTDQIEIRERNLQISTEAMKMKSWIETVKYILQSMEDGEITISAYDTAWIALVPALNGSSEPQFPSSLQWLINNQLQDGSWGDPLMFLIRDRIINTLACVLALKTWNIHSLGVNKGLSFLQTYIPKMNDEHDAHTPVGFEIVFPALMEDAKIMELDLPYDAEFLQKIYDERDLKMKRIPMKVLHEFPSTLLHSLEGLRDKVNWEELLKLQSKNGSFLFSPASTACALAQTSDTNCLRYLNEITKKYDGGAPNVYPVDLFERLWTVDRIERLGIARYFESEITDSLEYVYRYWTNQGIGWARDSPVKDVDDTSMAFRLLRSHGFDVTAEAFNHFKQDDQFFCFFGQTKQTVTGMYNLYRASQFSFPGESILEEARVFTKNFLEEKRAEKQLRDKWIIAKGLKEEVEYALKFPWYASQPRIDTRMYINQYRVDDVWIGKALYRMPIVNNKTYIELAKADFNICQSIHRTELHGIIRWYRESGLDELGLRQDQIVKSYFLAAIAIYEPDMASARLAWAKSAVLMAAIRIFFSGENCFAHHRRQFLDAFTRWDGRAMRDSPNSAKRLFSCLFRMVNLFSVDGVVAQGRDISGDLRHRWEHWLASEAEDLTDAQDHEKLGTEAEIVVLTAAFLGRETISPDLISHPDFSSIMKVTNTVCSLLRRIATYKEEGCDSPSGTEEDDRLKRRAEEGMGHLVRAVYRHQYSPVPSGVKRLCLVVGKSFYYAAHCNNEEVGNHVETVLFQPVY

SEQ ID NO: 7 - DNA, 1548 bp, Bradyrhizobium japonicum
  CDS (1)..(1548)
atgaacgctttgtctgaacacatcttatctgaattgagaagattattgtccgaaatgtctgacggtggttccgtcggtccttccgtttacgacaccgcccaagccttgagattccacggtaacgtcactggtagacaagatgcttacgcttggttgattgctcaacaacaagctgacggtggttggggttctgctgatttcccattattcagacatgccccaacctgggctgctctattggctttgcaaagagctgacccattgccaggtgctgctgatgccgtccaaaccgccaccagattcttgcaaagacaaccagacccatacgctcatgccgttccagaagatgctccaatcggtgctgaattgatcttgcctcaattctgtggtgaagctgcttctctattaggtggtgttgccttcccaagacacccagctttgttgccattgagacaagcttgtttggtcaaattgggtgccgttgccatgttgccatctggtcacccattgttgcactcctgggaagcctggggtacttctccaactactgcttgtccagacgatgacggttccatcggtatctctccagctgctactgctgcttggagagcccaagccgttaccagaggttccactccacaagtcggtagagctgatgcttacttgcaaatggcttccagagccaccagatctggtattgaaggtgttttcccaaatgtctggccaatcaacgtctttgaaccatgttggtctttgtacactttgcacttggctggtttgtttgctcatccagctttggctgaagccgtcagagtcattgttgctcaattggatgctagattaggtgtccacggtttaggtccagctttgcacttcgctgctgacgctgatgacaccgccgttgctctatgtgttttgcacttggctggtcgtgacccagctgttgacgctttgagacacttcgaaattggtgaattgttcgtcactttcccaggtgaaagaaacgcttctgtttccaccaacatccacgctttgcacgctttgagattgttgggtaagccagctgctggtgcttctgcttacgttgaagccaacagaaacccacacggtttatgggacaacgaaaagtggcacgtttcctggttatacccaactgctcacgccgttgctgctttggcccaaggtaagcctcaatggagagatgaaagagctttggccgctttgttgcaagctcaaagagatgacggtggttggggtgctggtcgtggttctactttcgaagaaaccgcctacgctttgtttgctttgcatgtcatggacggttctgaagaagctaccggtagaagaagaattgctcaagttgttgccagagctttggaatggatgttggctcgtcacgctgcccacggtttgccacaaactccattatggatcggtaaggaattgtactgtccaaccagagttgtcagagttgctgaattggctggtttatggttggctttgagatggggtcgtcgtgtcttggctgaaggtgctggtgctgcaccc

SEQ ID NO: 8 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAASLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLDARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 9 - DNA, 2364 bp, Lactuca sativa
  CDS (1)..(2364)
atgaacattgctcaaatcacctcttctgctatgttggttccatcttctcacatcccacaccgttcctgggttgtcaactgttgtatggttcaatacaacccatccggtctaagaactgcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 10 - protein, 788 aa, Lactuca sativa
MNIAQITSSAMLVPSSHIPHRSWVVNCCMVQYNPSGLRTASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 11 - DNA, 2250 bp, Lactuca sativa
  CDS (1)..(2250)
atggcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 12 - protein, 750 aa, Lactuca sativa
MASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 13 - DNA, 2271 bp, Picea glauca
  CDS (1)..(2271)
atgaagagagaacaatacactatcttgaacgaaaaggaatccatggctgaagaattaatcttgagaatcaagagaatgttttctgaaatcgaaaacactcaaacctctgcttctgcttacgacaccgcttgggttgccatggttccatctttggactcctctcaacaaccacaattccctcaatgtttgtcctggatcattgacaaccaattgttggatggttcctggggtatcccatacttgatcatcaaggacagactatgtcacactttagcttgtgtcattgctttgagaaaatggaacgctggtaaccaaaatgtcgaaaccggtctacgtttcttgagagaaaacattgaaggtatcgttcacgaagatgaatacactccaattggtttccaaatcattttcccagctatgttggaagaagctcgtggtttaggtctagaattgccatacgacttgactccaatcaagttgatgttgacccacagagaaaagatcatgaagggtaaggccattgaccacatgcacgaatacgactcttctttgatctacactgttgaaggtatccacaagatcgttgactggaacaaggttttgaaacatcaaaacaaggatggttctttgttcaactctccatctgctactgcttgtgctttgatgcacactagaaagtccaactgtttggaatacttgtcctccatgttgcaaaagttaggtaacggtgttccatccgtctacccaatcaacttatatgctcgtatctccatgattgacagattacaaagattaggtttggctagacatttcagaaacgaaatcattcacgctttggacgacatctacagatactggatgcaaaaggaaacctccagagaaggtaagtctttgaccccagatattgtctctacttccatcgctttcatgttgttgagattgcacggttacgatgttccagctgatgttttctgttgttaccatttgcactccattgaacaatctggtgaagccgttactgctatgttgtctttgtacagagcctctcaaattatgttcccaggtgaaaccattttggaagaaatcaagaccgtttctagaaagtacttggacaagagaaaggaaaacggtcgtatctactaccacaacattgttatgaaggacttgagaggtgaagtcgaatacgccttgtctgttccatggtacgcttccttggaaagaattgaaaacagaagatacattgaccaatacggtgtcaacgatacctggatcgctaagacctcttacaaaatcccatgtatctccaatgacttattcttggctttggccaagcaagactacaacatctgtcaagccattcaacaaaaggaattgagagaattggaaagatggtttgctgataacaaattctctcacttgaacttcgctcgtcaaaagttgatctactgttacttctctgccgctgctactttgttctctccagaattgtctgctgccagagttgtctgggctaagaacggtgttatcaccaccgtcgttgatgacttcttcgatgtcggtggttcttctgaagaaattcactctttcgtcgaagctgttagagtctgggacgaagctgctaccgatggtttgtctgaaaacgttcaaatcttattctccgctttatacaacaccgtcgacgaaattgtccaacaagccttcgttttccaaggtagagacatctccattcacttgagagaaatctggtacagattggtcaactccatgatgactgaagctcaatgggctagaactcactgtattccatccatgcacgaatacatggaaaacgctgaaccttctattgctttggaaccaatcgtcttgtcctctttatactttgttggtccaaagttgtctgaagaaatcatttgtcacccagaatactacaacttgatgcatttgttgaatatctgtggtagattgttgaacgatatccaaggttgtaaacgtgaagcccaccaaggtaagttgaactccgtcactttgtacatggaagaaaactctggtactaccatggaagatgctatcgtttacttgagaaagaccatcgacgaatccagacaattgctattgaaagaagttttaagaccatctattgttccaagagaatgtaaacaattgcactggaacatgatgagaatcttgcaattgttctacttgaagaacgatggttttacctctccaactgaaatgttgggttacgtcaacgccgtcattgtcgacccaattttg

SEQ ID NO: 14 - protein, 757 aa, Picea glauca
MKREQYTILNEKESMAEELILRIKRMFSEIENTQTSASAYDTAWVAMVPSLDSSQQPQFPQCLSWIIDNQLLDGSWGIPYLIIKDRLCHTLACVIALRKWNAGNQNVETGLRFLRENIEGIVHEDEYTPIGFQIIFPAMLEEARGLGLELPYDLTPIKLMLTHREKIMKGKAIDHMHEYDSSLIYTVEGIHKIVDWNKVLKHQNKDGSLFNSPSATACALMHTRKSNCLEYLSSMLQKLGNGVPSVYPINLYARISMIDRLQRLGLARHFRNEIIHALDDIYRYWMQKETSREGKSLTPDIVSTSIAFMLLRLHGYDVPADVFCCYHLHSIEQSGEAVTAMLSLYRASQIMFPGETILEEIKTVSRKYLDKRKENGRIYYHNIVMKDLRGEVEYALSVPWYASLERIENRRYIDQYGVNDTWIAKTSYKIPCISNDLFLALAKQDYNICQAIQQKELRELERWFADNKFSHLNFARQKLIYCYFSAAATLFSPELSAARVVWAKNGVITTVVDDFFDVGGSSEEIHSFVEAVRVWDEAATDGLSENVQILFSALYNTVDEIVQQAFVFQGRDISIHLREIWYRLVNSMMTEAQWARTHCIPSMHEYMENAEPSIALEPIVLSSLYFVGPKLSEEIICHPEYYNLMHLLNICGRLLNDIQGCKREAHQGKLNSVTLYMEENSGTTMEDAIVYLRKTIDESRQLLLKEVLRPSIVPRECKQLHWNMMRILQLFYLKNDGFTSPTEMLGYVNAVIVDPIL

SEQ ID NO: 15 - DNA, 900 bp, Bradyrhizobium japonicum
  CDS (1)..(900)
atgatccaaactgaaagagctgtccaacaagttttggaatggggtcgttctttgaccggtttcgctgacgaacacgctgtcgaagctgttcgtggtggtcaatacatcttacaaagaatccacccatctttgagaggtacttctgccagaactggtagagatccacaagatgaaactttgattgtcaccttttacagagaattggctttgttgttctggttagatgactgtaacgatttgggtttgatttccccagaacaattggctgctgtcgaacaagctttgggtcaaggtgtcccatgtgctttgccaggtttcgaaggttgtgccgttttgagagcttctttggccactttggcctacgacagaagagactacgctcaattgttggatgacaccagatgttactccgctgctttgagagctggtcatgcccaagctgttgctgctgaaagatggtcctacgctgaatacttgcacaacggtattgactccattgcttacgctaacgttttctgttgtttgtccctattatggggtttggacatggctactttgagagccagaccagctttcagacaagtcttgagattaatctctgccattggtagattacaaaacgatttgcacggttgtgacaaggaccgttctgctggtgaagctgacaacgctgtcatcttattgttgcaaagatacccagccatgccagttgttgaattcttgaacgatgaattggctggtcacaccagaatgttgcaccgtgtcatggctgaagaaagattcccagctccatggggtccattaatcgaagctatggctgccatcagagttcaatactacagaacctccacctctcgttacagatctgacgctgttagaggtggtcaaagagcccctgcc

SEQ ID NO: 16 - protein, 300 aa, Bradyrhizobium japonicum
MIQTERAVQQVLEWGRSLTGFADEHAVEAVRGGQYILQRIHPSLRGTSARTGRDPQDETLIVTFYRELALLFWLDDCNDLGLISPEQLAAVEQALGQGVPCALPGFEGCAVLRASLATLAYDRRDYAQLLDDTRCYSAALRAGHAQAVAAERWSYAEYLHNGIDSIAYANVFCCLSLLWGLDMATLRARPAFRQVLRLISAIGRLQNDLHGCDKDRSAGEADNAVILLLQRYPAMPVVEFLNDELAGHTRMLHRVMAEERFPAPWGPLIEAMAAIRVQYYRTSTSRYRSDAVRGGQRAPA

SEQ ID NO: 17 - DNA, 2838 bp, Phaeosphaeria sp.
  CDS (1)..(2838)
atgtttgctaagtttgatatgttggaagaagaagctagagctttggtcagaaaggtcggtaacgctgttgacccaatctacggtttctctaccacttcctgtcaaatctacgacaccgcttgggctgctatgatctccaaggaagaacacggtgacaaggtctggttgttcccagaatctttcaaatacttgttggaaaagcaaggtgaagatggttcctgggaaagacatccaagatccaagactgtcggtgttttgaacactgctgccgcttgtttggccttgttgagacacgtcaagaaccctttgcaattgcaagacattgctgcccaagacatcgaattgagaatccaaagaggtttgcgttctttggaagaacaattgattgcttgggatgatgtcttggacaccaaccacatcggtgtcgaaatgattgttccagctttgttggactacttgcaagccgaagatgaaaacgttgactttgaattcgaatcccactctctattgatgcaaatgtacaaagaaaagatggccagattctccccagaatccttatacagagctagaccatcttctgccttacataatttggaagctttgatcggtaaattggactttgacaaggttggtcaccacttgtacaacggttccatgatggcttccccatcttccactgctgcctttctaatgcatgcctctccatggtcccacgaagctgaagcttacctacgtcacgttttcgaagctggtactggtaagggttccggtggtttcccaggtacttacccaaccacttacttcgaattgaactgggttttgtccactttgatgaaatctggtttcactttatctgatttggaatgtgatgaattatcttccattgccaacaccattgctgaaggtttcgaatgtgaccacggtgtcatcggttttgctccaagagctgtcgatgtcgacgacaccgctaagggtttgttgactttaactttattaggtatggatgaaggtgtttctccagctccaatgattgctatgttcgaagccaaggaccacttcttgactttcttgggtgaacgtgacccatctttcacttctaactgtcacgttttgttatctttgttgcacagaaccgatttgttgcaatatttgcctcaaatcagaaagaccaccaccttcttgtgtgaagcctggtgggcttgtgacggtcaaatcaaggacaaatggcacttatctcacttgtacccaaccatgttgatggtccaagctttcgctgaaatcttattgaagtctgctgaaggtgaaccattgcacgatgctttcgatgccgctactttgtccagagtctccatttgtgttttccaagcttgtttgagaactctattggcccaatctcaagatggttcttggcacggtcaaccagaagcttcttgttacgctgtcttgactttggctgaatctggtcgtttggttttgttgcaagctttgcaaccacaaatcgctgctgccatggaaaaggccgctgatgttatgcaagctggtagatggtcctgttctgatcatgactgtgactggacctccaagaccgcttacagagttgacttagttgctgctgcttacagattagctgctatgaaagcttcttccaacttgactttcaccgtcgatgacaacgtttccaagagatccaacggtttccaacaattggtcggtagaactgacttgttctctggtgtcccagcctgggaattacaagcttctttcttggaatctgctttgttcgttcctttgttgagaaaccatagattggatgttttcgacagagatgacatcaaggtttctaaggaccactacttggacatgatcccattcacctgggttggttgtaacaacagatctagaacctacgtttctacctctttcttgttcgacatgatgatcatctccatgttgggttaccaaatcgatgaattcttcgaagctgaagctgctccagctttcgctcaatgtattggtcaattgcaccaagtcgtcgacaaggttgttgatgaagtcattgacgaagtcgtcgataaggttgtcggtaaggtcgttggtaaggttgttggtaaggttgtcgacgaacgtgttgactctccaacccacgaagccattgccatctgtaacatcgaagcttctttaagaagattcgtcgatcacgttttgcaccaccaacatgtcttacacgcttctcaacaagaacaagacattttgtggagagaattgagagccttcttgcacgctcacgttgtccaaatggccgacaactccactttggctccaccaggtagaactttcttcgactgggttagaaccactgctgctgaccacgttgcctgtgcttactctttcgctttcgcttgttgtatcacctctgctactatcggtcaaggtcaatctatgttcgctaccgtcaacgaattgtacttggtccaagctgctgctcgtcacatgaccaccatgtgtagaatgtgtaacgacattggttccgtcgacagagatttcatcgaagctaacattaactccgttcacttcccagaattctccactttgtctttggttgctgacaagaagaaagctttggccagattggctgcctacgaaaagtcttgtttgactcacactttggaccaatttgaaaatgaagttttacaatctccacgtgtttcttctgctgcctccggtgatttcagaaccagaaaggttgccgttgttagattctttgctgatgtcactgacttctacgatcaattgtacattttgagagatttgtcctcttctttgaagcatgtcggaacc

SEQ ID NO: 18 - protein, 946 aa, Phaeosphaeria sp.
MFAKFDMLEEEARALVRKVGNAVDPIYGFSTTSCQIYDTAWAAMISKEEHGDKVWLFPESFKYLLEKQGEDGSWERHPRSKTVGVLNTAAACLALLRHVKNPLQLQDIAAQDIELRIQRGLRSLEEQLIAWDDVLDTNHIGVEMIVPALLDYLQAEDENVDFEFESHSLLMQMYKEKMARFSPESLYRARPSSALHNLEALIGKLDFDKVGHHLYNGSMMASPSSTAAFLMHASPWSHEAEAYLRHVFEAGTGKGSGGFPGTYPTTYFELNWVLSTLMKSGFTLSDLECDELSSIANTIAEGFECDHGVIGFAPRAVDVDDTAKGLLTLTLLGMDEGVSPAPMIAMFEAKDHFLTFLGERDPSFTSNCHVLLSLLHRTDLLQYLPQIRKTTTFLCEAWWACDGQIKDKWHLSHLYPTMLMVQAFAEILLKSAEGEPLHDAFDAATLSRVSICVFQACLRTLLAQSQDGSWHGQPEASCYAVLTLAESGRLVLLQALQPQIAAAMEKAADVMQAGRWSCSDHDCDWTSKTAYRVDLVAAAYRLAAMKASSNLTFTVDDNVSKRSNGFQQLVGRTDLFSGVPAWELQASFLESALFVPLLRNHRLDVFDRDDIKVSKDHYLDMIPFTWVGCNNRSRTYVSTSFLFDMMIISMLGYQIDEFFEAEAAPAFAQCIGQLHQVVDKVVDEVIDEVVDKVVGKVVGKVVGKVVDERVDSPTHEAIAICNIEASLRRFVDHVLHHQHVLHASQQEQDILWRELRAFLHAHVVQMADNSTLAPPGRTFFDWVRTTAADHVACAYSFAFACCITSATIGQGQSMFATVNELYLVQAAARHMTTMCRMCNDIGSVDRDFIEANINSVHFPEFSTLSLVADKKKALARLAAYEKSCLTHTLDQFENEVLQSPRVSSAASGDFRTRKVAVVRFFADVTDFYDQLYILRDLSSSLKHVGT

SEQ ID NO: 19 - DNA, 2856 bp, Gibberella fujikuroi
  CDS (1)..(2856)
atgccaggtaagatcgaaaacggtactccaaaggatttaaagactggtaacgatttcgtttctgctgccaagtctttgttggacagagctttcaaatctcaccactcttactacggtttatgttccacttcttgtcaagtttacgacactgcttgggttgccatgatcccaaagaccagagataatgtcaaacaatggttgttccctgaatgtttccactacttgttgaaaacccaagctgctgatggttcctggggttctttgccaaccactcaaaccgctggtatcttggataccgcttccgctgtcttggctttgctatgtcacgctcaagaaccattgcaaatcttggatgtttctccagatgaaatgggtttgagaatcgaacacggtgttacttctttgaagagacaattggctgtctggaacgacgtcgaggacactaaccacattggtgtcgaatttattattccagctttattgtccatgttggaaaaggaattggatgttccatctttcgaattcccatgtagatccatcttggaaagaatgcacggtgaaaagttgggtcacttcgatttggaacaagtctacggtaagccatcttctttactacattctttggaagctttcttaggtaagttagacttcgacagattgtcccaccacttgtaccacggttccatgatggcttctccatcctccactgctgcctacttgattggtgctaccaaatgggatgacgaagctgaggactacttgagacacgttatgagaaacggtgctggtcatggtaacggtggtatctccggtactttcccaaccacccatttcgaatgttcctggatcattgccactttgttgaaggttggtttcaccttgaaacaaattgacggtgacggtttgagaggtctatccactatcttattggaagctttacgtgacgaaaacggtgtcatcggtttcgctccaagaaccgctgatgtcgacgacaccgccaaggctttgttggctttgtctttagttaaccaacctgtctctccagatatcatgattaaggttttcgaaggtaaggaccattttaccactttcggttctgaacgtgatccatctttgacctctaacttgcacgtcttgttgtctttgttgaagcaatctaacttgtctcaataccatccacaaatcttaaagactactttgtttacctgtagatggtggtggggttctgaccattgtgtcaaggacaagtggaacttgtctcatttgtacccaaccatgttgttggtcgaagccttcactgaagtcttgcacttgattgacggtggtgaattgtcctctttgttcgatgaatctttcaaatgtaagatcggtttgtccattttccaagctgttttgagaatcatcttgactcaagacaacgatggttcctggagaggttacagagaacaaacctgttacgccattttggctttggtccaagctcgtcacgtttgtttcttcactcacatggtcgatagattacaatcttgtgtcgacagaggtttctcctggttaaagtcttgttccttccactctcaagacttgacttggacctccaagactgcttacgaagttggtttcgttgctgaagcctacaaattggctgctttgcaatctgcttctttggaagttccagctgctaccatcggtcactccgttacctctgctgtcccatcttctgacttggaaaagtacatgagattggtccgtaagactgctttgttctctccattggacgaatggggtttgatggcttccattattgaatcttctttctttgtcccattgttgcaagctcaaagagtcgaaatctacccaagagataatatcaaggttgacgaggacaagtacttgtccatcattccatttacctgggttggttgtaataacagatctagaactttcgcttctaacagatggttatatgacatgatgtacttatctttgttgggttaccaaactgacgaatacatggaagctgttgccggtccagttttcggtgatgtttctctattgcaccaaaccatcgacaaggttatcgacaacaccatgggtaacttggccagagccaacggtactgttcactctggtaacggtcaccaacacgaatctccaaacattggtcaagttgaggacactttgaccagattcaccaactccgttttgaaccacaaggacgtcttgaactcttcttcttctgaccaagataccttacgtcgtgaattcagaactttcatgcacgctcacatcacccaaatcgaagataactccagattctccaagcaagcctcctctgatgccttttcttctccagaacaatcttacttccaatgggttaactccactggtggttctcacgttgcttgtgcctactccttcgccttttccaactgtttgatgtccgctaacttattgcaaggtaaggatgctttcccatctggtactcaaaagtacttgatctcctccgtcatgagacacgctaccaacatgtgtcgtatgtacaacgatttcggttctattgccagagacaacgctgaaagaaacgttaactccattcacttccctgaattcactctatgtaacggtacttctcaaaacttggatgaaagaaaggaaagattattgaagatcgctacctacgaacaaggttacttggacagagctttggaagctttggaaagacaatccagagatgacgctggtgacagagctggttccaaggacatgagaaaattgaagattgtcaaattgttctgtgatgttaccgacttgtacgaccaattgtacgtcatcaaggacttgtcctcttccatgaag

SEQ ID NO: 20 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 21 - DNA, 1533 bp, Lactuca sativa
  CDS (1)..(1533)
atggacttgcaaaccatggccccaatgggttctgctgctatcgccatcggtggtccagctgtcgccgttgctggtggtatctccttgttgttcttgaaatccttcttgtctcaacaaccaggtaacccaaaccacttgccatctgtcccagctgtcccaggtgttcctctattaggtaacttgttggaattgaaggaaaagaagccatacaagacctttaccaaatgggctgaaacttacggtccaatctactccatcaagaccggtgctacctccatggttgtcgttaactccaaccaattggccaaggaagctatggtcaccagattcgactccatctctaccagaaagttgtccaaggctttgcaaattttgactgctgacaagaccatggttgccatgtctgactacgatgactaccataaaactgtcaagagaaacttgttgacttctattttgggtccagctgctcaaaagagacacagagcccaccgtgacgctatgggtgacaacttgtccagacaattgcacgctttagctttgaactctcctcaagaagccattaacttcagacaaatcttccaatctgaattattcactttagctttcaagcaaactttcggtagagatatcgaatctatcttcgtcggtgatttgggtactaccatgaccagagaagaaatgttccaaattttggttgttgacccaatgatgggtgctattgacgttgactggagagacttcttcccatacttgaaatggattccaaacgccaaattggaagaaaagatcgaacaaatgtacatcagaagaaaggctgttatgaaggctgttatccaagaacacagaaagagaattgattctggtgaaaacttggattcttacattgatttcttgttggctgaagctcaaccattgactgaaaagcaattattgatgtccttgtgggaaccaattattgaaacttctgacaccaccatggttaccactgaatgggctatgtacgaattgtctaagcacccaaacaagcaacaaagattatacaatgaaatcagaaacatctgtggttctgaaaagatcactgaagaaaagttgtgtaagatgccatacttatctgctgtctttcacgaaactttacgtgttcactctccagtttccatcattccattacgttacgttcacgaaaacactgaattgggtggttaccatgtcccagctggtactgaattggctgtcaacatctacggttgtaacatggaaagagaaatctgggaaaacccagaagaatggtccccagaaagattcttggctgaaaacgaaccagttaacttgcaaaagaccatggcctttggtgctggtaagagagtctgtgccggtgctatgcaagctatgttgttggcttgtgtcggtattggtagaatggttcaagaattcgaatggagattgaaagatgacgtcgaagaagatgtcaacactttaggtttgaccactcaaagattgaacccaatgttggctgttatcaagcctaggaat

SEQ ID NO: 22 - protein, 511 aa, Lactuca sativa
MDLQTMAPMGSAAIAIGGPAVAVAGGISLLFLKSFLSQQPGNPNHLPSVPAVPGVPLLGNLLELKEKKPYKTFTKWAETYGPIYSIKTGATSMVVVNSNQLAKEAMVTRFDSISTRKLSKALQILTADKTMVAMSDYDDYHKTVKRNLLTSILGPAAQKRHRAHRDAMGDNLSRQLHALALNSPQEAINFRQIFQSELFTLAFKQTFGRDIESIFVGDLGTTMTREEMFQILVVDPMMGAIDVDWRDFFPYLKWIPNAKLEEKIEQMYIRRKAVMKAVIQEHRKRIDSGENLDSYIDFLLAEAQPLTEKQLLMSLWEPIIETSDTTMVTTEWAMYELSKHPNKQQRLYNEIRNICGSEKITEEKLCKMPYLSAVFHETLRVHSPVSIIPLRYVHENTELGGYHVPAGTELAVNIYGCNMEREIWENPEEWSPERFLAENEPVNLQKTMAFGAGKRVCAGAMQAMLLACVGIGRMVQEFEWRLKDDVEEDVNTLGLTTQRLNPMLAVIKPRN

SEQ ID NO: 23 - DNA, 1536 bp, Lactuca sativa
  CDS (1)..(1536)
atggatggtgtcattgacatgcaaaccattccattgagaaccgccattgccattggtggtactgctgttgctttggttgttgctctatacttctggttcttgagatcttacgcttctccatctcaccactctaaccatttgccacctgttccagaagttccaggtgtcccagtcttgggtaacttgttgcaattgaaagaaaagaagccatacatgactttcaccaaatgggctgaaatgtacggtccaatctactctatcagaactggtgctacctccatggttgttgtttcctctaacgaaattgccaaggaagttgttgtcactagattcccatccatctccaccagaaagttgtcttacgctttgaaggtcttgactgaagataagtccatggttgctatgtctgattaccatgactaccacaagaccgtcaaaagacacattttgactgctgtcttaggtccaaacgcccaaaagaagttccgtgctcacagagacaccatgatggaaaacgtttccaatgaattgcatgccttctttgaaaagaacccaaaccaagaagtcaacttgagaaagatcttccaatctcaattgttcggtttggccatgaagcaagctttgggtaaggatgtcgaatctatctacgtcaaggacttggaaactaccatgaagagagaagaaatctttgaagtcttggttgttgacccaatgatgggtgccattgaagtcgattggagagacttcttcccatacttgaaatgggttccaaacaaatctttcgaaaacatcattcacagaatgtacacccgtcgtgaagctgtcatgaaggctttgatccaagaacacaagaagagaattgcttctggtgaaaacttaaactcctacattgactacttgttgtctgaagctcaaactttgactgacaagcaattgttgatgtccctatgggaaccaatcattgaatcttccgacaccaccatggtcaccactgaatgggctatgtacgaattggctaagaatccaaacatgcaagacagattgtacgaagaaatccaatctgtttgtggttccgaaaagatcactgaagaaaacttgtctcaattaccatacttgtacgctgttttccaagaaactttgagaaagcactgtccagttccaatcatgccattgagatacgtccacgaaaacaccgttttgggtggttaccacgttccagctggtactgaagttgctatcaacatctatggttgtaacatggacaagaaggtctgggaaaacccagaagaatggaacccagaaagattcttatccgaaaaggaatccatggacttgtacaagaccatggccttcggtggtggtaagagagtttgtgctggttctttgcaagctatggtcatctcttgtatcggtattggtagattagtccaagattttgaatggaaattgaaagatgacgctgaagaagatgtcaacactttaggtttaaccactcaaaagttgcacccattattggctttgatcaaccctcgaaag

SEQ ID NO: 24 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 25 - DNA, 1575 bp, Sphaceloma manihoticola
  CDS (1)..(1575)
atgatggacgacaccacttctccatactccacttaccactctgtcagatccattagaaaccaatctgcttgggctttggctccaattgctgtctttatttgttacgttgtcttgagacacaacagaaagtctgtcccagctgcctccgctggttctcactccatcttggaaccattatggttagctagattacgtttcatcagagactccagattcatcatcggtcaaggttactccaagttcaaggatactatcttcaaggttaccaaggtcggtgctgacatcatcgttgttgctccaaagtacgtcgaagaaatcagaagattgtctcgtgacaccggtagatctgttgaaccattcatccacgatttcgctggtgaattgttgggtggtttgaatttcttggaatctgatttgcaaaccagagttgtccaacaaaagttgaccccaaacttgaaaactattgtcccagtcatggaagatgaaatgcattacgctttggtttctgaattggattcttgtttggacggttccgaacactggaccagagttgacatgattcacatgttgtccagaatcgtttccagaatttctgccagaatcttcttgggtccaaagtactgtagaaacgacttatggttaaagaccaccgctgaatacactgaaaacttgttcttgaccggtactctattgagatttgtcccaagaatgttgcaaaagtggatcgctccattactaccatctttccgtcaattgcaagaaaacagacaagctgccagaaagatcatttctgaaattttgactgaccatcaaccagaaaagcacgatgaaacctctgacaacggtgacccatacccagatatcttgactttgatgttccaagctgcccgtggtaaggaaaaggacatcgaagatatcgctcaacacactttgttgctatctttgtcctccattcacactaccgctttgaccatgactcaagctttgtacgacttgtgtgcctacccacaatacttggaccctgttaagcacgaaattgctgacaccttgcaatctgaaggttcctggtctaaggctatgttggacaaattgcacatgatggactctttgttgagagaatctcaaagattatctcctgttttcttattgactttcaacagaattttgcacaccccattgactttgtccaacggtatccatttgccaaagggtactagaattgctgctccttctgatgccattttgaacgatccatctttagtcccaggtccacaaccagctgacactttcgacccatttagatacatcaaccactccactggtgatgctaagaaaaccaagaccaacttccaaaccacttctttgcaaaacatggctttcggttacggtaaatacgcttgtccaggtcgtttctatgttgccaacgaaatcaaattggttttaggtcacttgttgatgcactacgaattcaagttcccaccaggtatgggtagaccagttaactccaccgtcgatactgacatgtacccagatttgggtgccagattgttggttagaaagagaaagatggaagaa

SEQ ID NO: 26 - protein, 525 aa, Sphaceloma manihoticola
MMDDTTSPYSTYHSVRSIRNQSAWALAPIAVFICYVVLRHNRKSVPAASAGSHSILEPLWLARLRFIRDSRFIIGQGYSKFKDTIFKVTKVGADIIVVAPKYVEEIRRLSRDTGRSVEPFIHDFAGELLGGLNFLESDLQTRVVQQKLTPNLKTIVPVMEDEMHYALVSELDSCLDGSEHWTRVDMIHMLSRIVSRISARIFLGPKYCRNDLWLKTTAEYTENLFLTGTLLRFVPRMLQKWIAPLLPSFRQLQENRQAARKIISEILTDHQPEKHDETSDNGDPYPDILTLMFQAARGKEKDIEDIAQHTLLLSLSSIHTTALTMTQALYDLCAYPQYLDPVKHEIADTLQSEGSWSKAMLDKLHMMDSLLRESQRLSPVFLLTFNRILHTPLTLSNGIHLPKGTRIAAPSDAILNDPSLVPGPQPADTFDPFRYINHSTGDAKKTKTNFQTTSLQNMAFGYGKYACPGRFYVANEIKLVLGHLLMHYEFKFPPGMGRPVNSTVDTDMYPDLGARLLVRKRKMEE

SEQ ID NO: 27 - DNA, 1440 bp, Artemisia annua
  CDS (1)..(1440)
atgccaatgaccgtcatgttgttgttcgttttcttattattcattgccatctgtttcttcttggtccacagacacaactccaccaccaccaagaacttgccaccaggttctttcggttggccattcatcggtgaaactttggcttacatcagatccaagagaggtggtgacccagaaagattcaccaaggaaagaattgaaaagtacggttccactttagtctttaagacctctgttgctggtgaaagaatggctgtcttttgtggtccagaaggtaacaagttcttgtttggtaacgaaaacaaattggttgcttcctggtggccaaactctgttagaattttgttcgaaaagtgtttgattaccatcagaggtgacgaagctaaatggttacgtaaaatgatgttcgcttacttgggtccagacgctctatccaacagatacactggtactatggaagttgttaccagattgcacatccaaaaccactggcaaggtaagtctgaattgaaggtctttgaaaccgttagaccatacttgttcgaattggcctgtagattattcttgtctttggatgacccaaagcacgttgctgaattgggtactttattcaacactttcttgaagggtttgactgaattgccaatcaacattccaggtactagattctacagagccaagagagctgccaacgccatcaagaaacaattgattgtcatcatcaagcaacgtcgtcaagctttgaagcaagaagatcaatcttcttctttcgaagatttgctatctcatttgttagtctcctctgatgaaaacggtagattcttgtccgaagctgaaattgccaataatgtcttgttgttgttgtttgctggtcacgacacttctgctgtttccatcactttgttgatgaagtctttggctgaacaccctcaagtctacgacaacgttttgaaggaacaattaggtatcttggaagccaaggctccaggtgaaatgttgaactgggaagatatccaaaagatgagatactcctggtacgttgtttgtgaagtcatgagattgattccacctgttgttggttctttcagagaagctttggttgatttcgaatacgctggttacactattccaaagggttggaagatcatctggtctgctgtcatgactcacaaggaagaaaacaacttcccaaacgctactaagttcgacccatccagattcgaaggtgctggtccaaccccattcacctacgttccattcggtggtggtccaagaatgtgtttgggtaaggaattggctcgtgtcagaattttggttttcttacataacatcatgaccaaattcaaatgggacttgttgattccagacgaaaagatcggttacgacccattggctaccccagtcaagggtttgccagtcagattgcaccctcaccaagtg

SEQ ID NO: 28 - protein, 480 aa, Artemisia annua
MPMTVMLLFVFLLFIAICFFLVHRHNSTTTKNLPPGSFGWPFIGETLAYIRSKRGGDPERFTKERIEKYGSTLVFKTSVAGERMAVFCGPEGNKFLFGNENKLVASWWPNSVRILFEKCLITIRGDEAKWLRKMMFAYLGPDALSNRYTGTMEVVTRLHIQNHWQGKSELKVFETVRPYLFELACRLFLSLDDPKHVAELGTLFNTFLKGLTELPINIPGTRFYRAKRAANAIKKQLIVIIKQRRQALKQEDQSSSFEDLLSHLLVSSDENGRFLSEAEIANNVLLLLFAGHDTSAVSITLLMKSLAEHPQVYDNVLKEQLGILEAKAPGEMLNWEDIQKMRYSWYVVCEVMRLIPPVVGSFREALVDFEYAGYTIPKGWKIIWSAVMTHKEENNFPNATKFDPSRFEGAGPTPFTYVPFGGGPRMCLGKELARVRILVFLHNIMTKFKWDLLIPDEKIGYDPLATPVKGLPVRLHPHQV

SEQ ID NO: 29 - DNA, 1365 bp, Ricinus communis
  CDS (1)..(1365)
atggaattggtcatgttcccagtcttggctttggtttccactttgttcttgttggctttgcacttcatcatcagaactttgaaggaaagattattcggttctccaaatttgccaccaggtagattaggttggccattgattggtgaaaccccagctttcttcagagctggtttcgaagccaagccagaaaagttcatcggtgaaagaatggaaaagtacgactctcgtgttttcaagacctctttgttgggtaagcctttcgctgtcatttctggtactgctggtcacaagttcttgttttccaacgaaaacaaattggttaacttgtggtggccagaatccgtcagaatgttgttcaagtctgctttggtttccgttgttggtgacgaagccaagagaatcagaaagatgttgatgactttcttaggtttggatgctttgaagaactacactgaaagaattgacatggtcacccaacaacacatcagaacctactgggaaggtaaggaagaagttaccgtttactccactttgaaattgtacactttcaccttggcttgtaacttgtttgcctccatcaacgaccctgaaagattatccaagttgggtgctcacttcgatgttttcgttaagggtgttatctctttgccaatttccattccaggtactagattatacaaatccatgaaggctgccaacgccattagagaagaattgaaattgattgtccgtgacagaaaggaagctttggaaagaaagatggcttctccaactcaagatttgttgtcttatttgttggtcgactctgacaccaacggtcgtttcttgtctgaaatggaaatcttggacaacatcatgttgctattgtacgctgaacaattggaaattgctaactccaagaagccaggtgaattattgcaatgggaagatgtccaaaagatgagatactcctggaacgtcatctctgaagtcttgagattgtctccaccagtttcttctgcttacagacacgccattgttgactttacctacgaaggttacaccattccaaagggttggcaattgttcacctctttcggtactacccaccgtgacccagctttattcccaaacccagaaagattcgatgcttccagatttgaaggtaacggtccaccttcttactcttacatcccattcggtggtggtccaagaatgtgtattggttacgaatttgccagattggaaatgttgatcttcttacataacatcatcaagagattcaaatgggatatcttgatcccagatgaacaattcggttacaacccattattggctccatctcaaggtttcccagtcagattaagaccacaccactctcatcta

SEQ ID NO: 30 - protein, 455 aa, Ricinus communis
MELVMFPVLALVSTLFLLALHFIIRTLKERLFGSPNLPPGRLGWPLIGETPAFFRAGFEAKPEKFIGERMEKYDSRVFKTSLLGKPFAVISGTAGHKFLFSNENKLVNLWWPESVRMLFKSALVSVVGDEAKRIRKMLMTFLGLDALKNYTERIDMVTQQHIRTYWEGKEEVTVYSTLKLYTFTLACNLFASINDPERLSKLGAHFDVFVKGVISLPISIPGTRLYKSMKAANAIREELKLIVRDRKEALERKMASPTQDLLSYLLVDSDTNGRFLSEMEILDNIMLLLYAEQLEIANSKKPGELLQWEDVQKMRYSWNVISEVLRLSPPVSSAYRHAIVDFTYEGYTIPKGWQLFTSFGTTHRDPALFPNPERFDASRFEGNGPPSYSYIPFGGGPRMCIGYEFARLEMLIFLHNIIKRFKWDILIPDEQFGYNPLLAPSQGFPVRLRPHHSHL

SEQ ID NO: 31 - DNA, 1428 bp, Stevia rebaudiana
  CDS (1)..(1428)
atgattcaagttttgaccccaatcttgttgttcttgatcttcttcgtcttttggaaggtctacaagcaccaaaagaccaagatcaacttgcctccaggttctttcggttggccattcttgggtgaaactttagctttgttgagagctggttgggactctgaaccagaaagattcgttagagaaagaatcaagaagcatggttctccattggttttcaagacctctttgttcggtgacagattcgctgtcttgtgtggtccagctggtaacaaattcttgttctgtaacgaaaacaaattggttgcttcctggtggccagttccagttagaaagttgttcggtaagtccttgttgactatcagaggtgacgaagccaagtggatgagaaagatgttattgtcttacttgggtccagatgcctttgctacccactacgctgtcaccatggacgttgttacccgtcgtcacattgatgtccactggagaggtaaggaagaagttaacgttttccaaaccgtcaaattgtacgctttcgaattggcttgtagattattcatgaacttggatgacccaaaccatattgccaaattaggttctttattcaacatcttcttgaagggtatcatcgaattgccaattgatgttccaggtactagattctactcctccaagaaggctgctgctgccatcagaattgaattgaagaaattgatcaaggccagaaagttggaattgaaggaaggtaaggcttcttcctctcaagatttgctatcccacttattgacctctccagacgaaaatggtatgttcttgactgaagaagaaattgtcgacaacatcttattgctattgttcgctggtcacgacacctctgctctatccattactttgttgatgaaaactttgggtgaacactctgatgtttacgacaaggtcttaaaggaacaattggaaatctccaagactaaggaagcttgggaatctttgaaatgggaagatatccaaaagatgaagtactcctggtctgttatctgtgaagtcatgagattgaaccctccagtcattggtacttacagagaagctttggtcgatatcgactacgctggttacaccattccaaagggttggaagttgcactggtctgccgtttccactcaaagagatgaagctaacttcgaagatgtcaccagatttgacccatctcgtttcgaaggtgctggtccaactccattcacttttgttccattcggtggtggtccaagaatgtgtttgggtaaggaattcgctagattagaagttttggctttcttgcacaacattgtcaccaactttaaatgggacttgttgattccagacgaaaagatcgaatacgacccaatggctactccagccaagggtttgccaatcagattgcaccctcaccaagtc

SEQ ID NO: 32 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 33 - DNA, 1575 bp, Arabidopsis thaliana
  CDS (1)..(1575)
atggaatctttagtcgttcacaccgtcaatgccatctggtgtattgtcattgttggtattttctctgttggttaccacgtttacggtcgtgccgttgttgaacaatggagaatgagaagatctttgaaattgcaaggtgtcaagggtccaccaccatccattttcaacggtaatgtctctgaaatgcaaagaatccaatctgaagctaagcactgttccggtgacaacatcatttctcacgattactcctcctctttgttccctcactttgaccactggagaaagcaatacggtagaatctacacctactccactggtttgaaacaacatttgtacatcaaccatccagaaatggtcaaggaattatctcaaaccaacactttgaacttaggtcgtatcactcacatcaccaagagattgaacccaatcttaggtaacggtatcatcacttccaacggtccacactgggctcatcaaagaagaattattgcttacgaattcacccacgacaaaatcaagggtatggtcggtttgatggtcgaatctgccatgccaatgttgaacaaatgggaagaaatggttaagagaggtggtgaaatgggttgtgacatccgtgttgacgaagatttgaaggatgtttctgctgatgtcattgctaaggcttgtttcggttcctctttctccaagggtaaggctatcttctccatgatcagagacttgttgactgccatcactaagagatctgttttgttcagattcaacggtttcaccgacatggttttcggttccaagaagcatggtgatgtcgatatcgatgctttggaaatggaattggaatcttctatctgggaaaccgttaaggaaagagaaattgaatgtaaggacactcacaagaaggatttgatgcaattaatcttggaaggtgccatgagatcttgtgacggtaacttgtgggacaagtctgcttacagaagatttgttgtcgacaactgtaaatccatctactttgccggtcacgactctactgctgtctccgtttcctggtgtttgatgttgctagctttgaacccatcctggcaagtcaagatcagagatgaaatcttatcttcttgtaagaacggtattccagatgctgaatccattccaaacttgaagaccgttaccatggtcattcaagaaactatgagattgtacccaccagctccaattgtcggtagagaagcttccaaggacatcagattaggtgacttggttgttccaaagggtgtttgtatctggactttgattccagctttgcaccgtgacccagaaatctggggtccagatgctaacgacttcaagccagaaagattctctgaaggtatttccaaggcttgtaaatacccacaatcttacatcccattcggtttgggtccaagaacctgtgtcggtaagaacttcggtatgatggaagtcaaagttttggtttctttgattgtttccaagttctctttcaccttgtctccaacttaccaacactctccatctcacaagttgttggttgaacctcaacacggtgttgtcattagagtcgtt

SEQ ID NO: 34 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 35 - DNA, 1437 bp, Ixeris dentata var. albiflora
  CDS (1)..(1437)
atggatgccgttgccgtcaactctgaaaccatgtcccacgttgttttcattccattcccagctcaatctcacatcaagtgtatgttgaagttggcccgtctattacaccacaagggtttacacatcactttcgtcaacactgaattgaaccacaaccaattgttatcttctggtggtccaaactctttggacggtgaaccaggtttcagattcaagaccattccagatggtgttccagaaggtgctccagacttcatgtacgctttatgtgactctgtcttgaacaaaatgttggacccatttgtcgatttgattggtagattggaatctccagccacctgtatcatcggtgacggtatgatgcctttcactgttgctgctgctgaaaagttgaaattgccaattatgcatttctggactttcccagctgctgctttcttgggttactaccaagctccaaacttgattgaaaagggtttcatcccacctaaggacgaatcctggtccaccaacggttacttggaaaccgttgttgactccatttctggtttggaaggtttcagaatcagagatatcccagcttacttcagaaccactgacccaaacgattctgatttcaactacatcatcgaatgtgttaaggccatcagaaaggtttccaacattgtcttgcacactttcgaagaattggaatctaccattatcaaggccttgcaaccaatgatcccacacgtctacaccattggtccattggaattgttgttgaacccaatcaagttagaagaagaaactgaaaagttggacattaaaggttactctttatggaaggaagatgacgaatgtttgaaatggttggactccaaggaaccaaactccgtcatttacgtcaactttggttctttgatctccatgtccaaggaacaattagctgaatttggttggggtttggttaactctaaccactgtttcttgtgggttatcagaagagacttggttgtcggtgattctgctccattgcctccagaattgaaagaacgtatcaacgaaagaggtttcatcgcttcctggtgtccacaagaaaaggtcttgaaacattcctctgttggtggtttcttgactcactgtggttggggttccatcatcgaatctctatctgctggtgtcccaatgttgtgttggccatacttgtgggaccaaccaaccaactgtcgtcaagcttgtaaggaatgggaagttggtttggaaattgaaggtaacgttaacaaggatgaagtcgaaagattgaccagagaattgatcggtggtgaaaagggtaagcaaatgagatccaaggctttggaatggaagaagaagatcgaaattgctactggtccaaagggttcttcttctttaaatgtcgaaagattggctaacgacattaacatgttctccagaaat

SEQ ID NO: 36 - protein, 479 aa, Ixeris dentata var. albiflora
MDAVAVNSETMSHVVFIPFPAQSHIKCMLKLARLLHHKGLHITFVNTELNHNQLLSSGGPNSLDGEPGFRFKTIPDGVPEGAPDFMYALCDSVLNKMLDPFVDLIGRLESPATCIIGDGMMPFTVAAAEKLKLPIMHFWTFPAAAFLGYYQAPNLIEKGFIPPKDESWSTNGYLETVVDSISGLEGFRIRDIPAYFRTTDPNDSDFNYIIECVKAIRKVSNIVLHTFEELESTIIKALQPMIPHVYTIGPLELLLNPIKLEEETEKLDIKGYSLWKEDDECLKWLDSKEPNSVIYVNFGSLISMSKEQLAEFGWGLVNSNHCFLWVIRRDLVVGDSAPLPPELKERINERGFIASWCPQEKVLKHSSVGGFLTHCGWGSIIESLSAGVPMLCWPYLWDQPTNCRQACKEWEVGLEIEGNVNKDEVERLTRELIGGEKGKQMRSKALEWKKKIEIATGPKGSSSLNVERLANDINMFSRN

SEQ ID NO: 37 - DNA, 1446 bp, Ricinus communis
  CDS (1)..(1446)
atgggttccattgtccgtgaccacgacaagccacacgttgtttgtgttccatacccagctcaaggtcacgttaacccaatggtcaaattggccaagttgttgcactacaacgatttccacgtcactttcgtcaacactgaatacaaccacagaagattattgaactccagaggtccttcttctttggacggtttgccagatttcagattcgaagccatctctgacggtttgccaccatctgatgctaacgctacccaagatatcccatctctatgtgactctacctccaagaactctttggctccattcagaaacttgttgttgaagttgaaatcctctgactctttgccaccagttacctgtatcatttctgatgcttgtatgtccttcactttggatgctgctgaagaatttggtattccagaaatcttattctggaccccatcttcttgtggtgttttgggttactctcaataccacactttgattgaaaagggtttgactccattaaaggacgcctcttacttgaccaacggttacttggaaaccactttggactggattccaggtatgaaggatatcagattcagagatttgccatctttcatcagaaccactgacagaaacgatatcatgttgaactttgttgtccgtgaattggaaagaacttccagagcttctgctgttgttttcaacactttctacgccttcgaaaaggacgtcttagatgtcttatccaccatgttcccaccaatctactccatcggtccattgcaattgttggttgaccaaatcccaattgacagaaacttgggtaacattggttccaacttatggaaggaacaaccagaatgtattgactggttggacaccaaggaaccaaactctgttgtctacgtcaacttcggttccatcactgttatcactcctcaacaaatgattgaattcgcttggggtctagcttcttctaagaaaccattcttatggatcatcagaccagacttggttatcggtgaaaacgctatgttgccagctgaattcgtttctgaaaccaaggatcgtggtatgttggcttcttggggtcctcaagaacaaattttgaaacatccagctgtcggtggtttcttgtctcacatgggttggaactccactttggactccatgtccggtggtgtcccaatggtttgttggccattctttgctgaacaacaaaccaactgtagatttgcttgtaccgaatggggtgttggtatggaaattgacaacaatgtcaagagagatgaagtcaagaagttggttgaagttttgatggacggtaagaaaggtaaggaaatgaagtccaaggccatggaatggaaaaccaaggctgaagaagctgccaagccaggtggttcctctcataacaacttggacagattagtcaagttcatcaagggtcaaaagaat

SEQ ID NO: 38 - protein, 482 aa, Ricinus communis
MGSIVRDHDKPHVVCVPYPAQGHVNPMVKLAKLLHYNDFHVTFVNTEYNHRRLLNSRGPSSLDGLPDFRFEAISDGLPPSDANATQDIPSLCDSTSKNSLAPFRNLLLKLKSSDSLPPVTCIISDACMSFTLDAAEEFGIPEILFWTPSSCGVLGYSQYHTLIEKGLTPLKDASYLTNGYLETTLDWIPGMKDIRFRDLPSFIRTTDRNDIMLNFVVRELERTSRASAVVFNTFYAFEKDVLDVLSTMFPPIYSIGPLQLLVDQIPIDRNLGNIGSNLWKEQPECIDWLDTKEPNSVVYVNFGSITVITPQQMIEFAWGLASSKKPFLWIIRPDLVIGENAMLPAEFVSETKDRGMLASWGPQEQILKHPAVGGFLSHMGWNSTLDSMSGGVPMVCWPFFAEQQTNCRFACTEWGVGMEIDNNVKRDEVKKLVEVLMDGKKGKEMKSKAMEWKTKAEEAAKPGGSSHNNLDRLVKFIKGQKN

SEQ ID NO: 39 - DNA, 1374 bp, Ixeris dentata var. albiflora
  CDS (1)..(1374)
atggctgaagaacacaacaagaccaacaactcttctcctcacgttgtcatcttcccattcccatctcaaggtcacattaacccattgattcaatttgccaagagattgtcctccaagggtgtcaagccaactttgatcactaccatctacattgctaagacctctccatacccaaactcttccattgttgttgaaccaatttctgatggtttcgacgacggtggtttcaagtctgccacttctgctgaatcttacattgacactttccaccaagttggttccaaatctctagctaacttgatcagaaagttggtcaacgaaggtaaccatgtcgatgctatcatctacgactctttcgtcacctgggctttggatgttgctatggaatacggtattgacggtggttgtttcttcacccaagcttgtgctgtcaacaacatctactaccatgtttacaagggtgtcttggaaattccattgcaagctgctgctccaccaaccgtcactatcttattgcctgaattgcctcaattacaattatgggaaactccatcctttgtccacaacccaggtccatacccaggttgggctcacattgttttcaaccaattcccaaacatccacaacgccagatgggttttctccaacactttcttcaaattggaagaacaagttatcaaatggatgagattgatgtggccattgatggttgtcggtccaactgttccatccatgtacttggacaagagattagaagatgacgatgactacggtatgtctttgttgaagccaaaccacattgaatgtatgggttggttgaataacaaaccaaagggttccgttgtctacgtttccttcggttcctacggtgaattaggtgttgctcaaatggaagaaattgcttggggtttgaacgaatcttccgtcaactatttatgggttgtcagagaaactgaaaaggaaaagttgccaaagtctttcttggctaatggtttgattgttgaatggtgtcgtcaattggaagttttggctcacgaagctgtcggttgtttcgtcactcactgtggtttcaactcctctttggaaaccatctctttgggtgtcccagttgttgccatcccacaatggaccgatcaaaccaccaacgctaagtgtttggaagatatctggggtgttggtatcagagccaagactccagtcaccagaaccaacttggtctggtgtatcaaggaaatcatggaaggtgaacgtggtgctgttgctagaaagaacgccatcaagtggaaggacttggccattgaagctgtctctccaggtggttcctctgacaaggacatcaacgaatttgtttctcaattgtctccaatcaaatgt

SEQ ID NO: 40 - protein, 458 aa, Ixeris dentata var. albiflora
MAEEHNKTNNSSPHVVIFPFPSQGHINPLIQFAKRLSSKGVKPTLITTIYIAKTSPYPNSSIVVEPISDGFDDGGFKSATSAESYIDTFHQVGSKSLANLIRKLVNEGNHVDAIIYDSFVTWALDVAMEYGIDGGCFFTQACAVNNIYYHVYKGVLEIPLQAAAPPTVTILLPELPQLQLWETPSFVHNPGPYPGWAHIVFNQFPNIHNARWVFSNTFFKLEEQVIKWMRLMWPLMVVGPTVPSMYLDKRLEDDDDYGMSLLKPNHIECMGWLNNKPKGSVVYVSFGSYGELGVAQMEEIAWGLNESSVNYLWVVRETEKEKLPKSFLANGLIVEWCRQLEVLAHEAVGCFVTHCGFNSSLETISLGVPVVAIPQWTDQTTNAKCLEDIWGVGIRAKTPVTRTNLVWCIKEIMEGERGAVARKNAIKWKDLAIEAVSPGGSSDKDINEFVSQLSPIKC

SEQ ID NO: 41 - DNA, 1362 bp, Populus trichocarpa
  CDS (1)..(1362)
atggacaacaagaagtctcatgtcattgtcttgacctacccagctcaaggtcacatcaacccattgttgcaattcgccaagagattagcttccaagggtttgaaggccactttggctaccacctactacactgttaactccattgacgctccaactgtcggtgttgaaccaatctctgatggtttcgatgaaggtggtttcaagcaagcttcctctctagatgtctacttggaatctttcaagaccgtcggttccagaaccttgactgaattagtctttaaattcaaggcttctggttctcctgttaactgtgttgtttacgactccatgttgccatgggctttggacgttgccagagatttgggtatctacgctgctgccttcatgaccacctctgcttccgtctgttccatgtactggagaattgacttaggtttattgtctttgccattgaagcaacaaaccgctaccgtttctttgccaggtttgccaccattgggttgttgtgatttgccatctttcttagctgaaccaacttctcaaactgcttacttggaagttatcatggaaaagttccactccttgaacgaagatgactgggttttctgtaactctttcgaagatttggaaattgaattggtcaaggctatgagaggtaaatggccattggttatggttggtccaatggttccatctgcctacttggaccaacaaattgatggtgaccgtgcctacggtgcttctttgtggaaaccaacttcttctcaatgtttcacctggttggacactaagcctccaagatctgtcatctacgtttcctttggttccatgggtaacatctccgctgaacaagttgaagaaattgcttggggtttgaaggcttccaacagaccattcttatgggttatgaaggaatctgaaaagaaattgccaactggtttcttgaactctgtcggtgaaaccggtatggttgtttcctggtgtaaccaattggaagtcttggctcaccaagctatcggttgtttcgtcacccactgtggttggaactccactttggaaggtttgggtttaggtgttccaatggtttgtgttactgaaagatctgaccaaccaatgaacgctaagttcgttgaagatgtctggaaggtcggtgtcagagctaagaaggacgaagttggtattgtcactagagaagaattggaaaagtgtatcagaggtgtcatggacggtgaaaacggtgaagaaatcaagagaaacgccaacaaatggagagaattagctcgttctgccgtttccgtcggtggttcttctgacatgaacatcaatgaatttgttgtcaaattgttggaaggtaagaagggg

SEQ ID NO: 42 - protein, 454 aa, Populus trichocarpa
MDNKKSHVIVLTYPAQGHINPLLQFAKRLASKGLKATLATTYYTVNSIDAPTVGVEPISDGFDEGGFKQASSLDVYLESFKTVGSRTLTELVFKFKASGSPVNCVVYDSMLPWALDVARDLGIYAAAFMTTSASVCSMYWRIDLGLLSLPLKQQTATVSLPGLPPLGCCDLPSFLAEPTSQTAYLEVIMEKFHSLNEDDWVFCNSFEDLEIELVKAMRGKWPLVMVGPMVPSAYLDQQIDGDRAYGASLWKPTSSQCFTWLDTKPPRSVIYVSFGSMGNISAEQVEEIAWGLKASNRPFLWVMKESEKKLPTGFLNSVGETGMVVSWCNQLEVLAHQAIGCFVTHCGWNSTLEGLGLGVPMVCVTERSDQPMNAKFVEDVWKVGVRAKKDEVGIVTREELEKCIRGVMDGENGEEIKRNANKWRELARSAVSVGGSSDMNINEFVVKLLEGKKG

SEQ ID NO: 43 - DNA, 1377 bp, Nicotiana tabacum
  CDS (1)..(1377)
atgaccactcaaaaggctcactgtttgatcttaccatacccagctcaaggtcacatcaacccaatgttgcaattttccaagagattacaatctaagggtgtcaagatcaccattgctgctaccaagtctttcttaaagaccatgcaagaattgtccacttctgtctctgttgaagctatctctgatggttacgatgacggtggtagagaacaagctggtactttcgttgcttacatcaccagattcaaggaagttggttctgacactctatcccaattaatcggtaagttgaccaactgtggttgtccagtttcttgtatcgtctacgatcctttcttgccatgggctgtcgaagtcggtaacaactttggtgttgccactgctgctttcttcactcaatcttgtgctgttgacaacatctactaccatgtccacaaaggtgttttgaaattgccaccaactgatgttgacaaggaaatttccattccaggtttgttgaccattgaagcttctgatgttccatctttcgtttccaacccagaatcttccagaatcttggaaatgttggtcaaccaattctccaatttggaaaacactgactgggttttgatcaactctttctacgaattggaaaaggaagtcattgactggatggccaagatctacccaatcaagaccattggtccaaccattccatccatgtacttggacaaaagattaccagatgacaaggaatacggtttgtccgtctttaaaccaatgaccaatgcttgtttgaactggttgaaccaccaaccagtttcttccgttgtctacgtttctttcggttctttggctaagttggaagctgaacaaatggaagaattggcttggggtttgtccaactccaacaagaacttcttatgggttgtcagatctactgaagaatccaaattgccaaacaacttcttggaagaattggcttctgaaaagggtttggttgtttcctggtgtccacaattacaagttttggaacacaagtccatcggttgtttcttgactcactgtggttggaactctactttggaagccatctctttgggtgttccaatgattgccatgcctcactggtctgaccaaccaaccaacgccaagttggtcgaagatgtctgggaaatgggtatcagaccaaagcaagatgaaaagggtttagtccgtcgtgaagtcattgaagaatgtatcaagattgtcatggaagaaaagaagggtaagaagatcagagaaaacgccaagaaatggaaggaattggccagaaaggctgttgacgaaggtggttcttctgacagaaacattgaagaattcgtttccaaattggtcaccattgcttctgtcgagagt

SEQ ID NO: 44 - protein, 459 aa, Nicotiana tabacum
MTTQKAHCLILPYPAQGHINPMLQFSKRLQSKGVKITIAATKSFLKTMQELSTSVSVEAISDGYDDGGREQAGTFVAYITRFKEVGSDTLSQLIGKLTNCGCPVSCIVYDPFLPWAVEVGNNFGVATAAFFTQSCAVDNIYYHVHKGVLKLPPTDVDKEISIPGLLTIEASDVPSFVSNPESSRILEMLVNQFSNLENTDWVLINSFYELEKEVIDWMAKIYPIKTIGPTIPSMYLDKRLPDDKEYGLSVFKPMTNACLNWLNHQPVSSVVYVSFGSLAKLEAEQMEELAWGLSNSNKNFLWVVRSTEESKLPNNFLEELASEKGLVVSWCPQLQVLEHKSIGCFLTHCGWNSTLEAISLGVPMIAMPHWSDQPTNAKLVEDVWEMGIRPKQDEKGLVRREVIEECIKIVMEEKKGKKIRENAKKWKELARKAVDEGGSSDRNIEEFVSKLVTIASVES

SEQ ID NO: 45 - DNA, 1434 bp, Vaccaria hispanica
  CDS (1)..(1434)
atgtccaacaatgaaaacaatgccactcaagttatcgttttgccataccacggtcaaggtcacatgaacaccatggttcaatttgccaagagattagcttggaagggtgtccacgtcaccattgctaccactttcaacactatccaacaaatgaaattgaacatttcttcttacaactccatcactttggaaccaatctacgatgacactgatgactccactttgcacatcaaggacagaatggccagatttgaagctgaagccgcttccaatttgaccagagttttggaagccaagaaacaacaacaagctttaaacaagaagtgtttgttggtttaccacggttctttgaactgggctttagtcgttgctcaccaacaaaacgttgctggtgctgctttcttcaccgctgcttctgcttctttcgcttgttactactacttgcatttggaatctcaaggtaagggtgtcgacttggaagaattaccatccatcttaccaccaccaaaggtcattgttcaaaagttgccaaagtctttcttagcttacggtgacaacaactctcacaacaacaacaacaacaacaacaacaacaacaacaacaacaacatgggtttgcacccattggtcttgtggttgttgaaagattacggtaactccgtcaaggctgacttcgttttgttgaactctttcgacaaattggaagaagaagctatcaaatggatctctaacatctgttccgtcaagactatcggtccaaccattccatctacctacttggacaagcaaattgaaaacgatgttgactacggtttcaaccaatacaagccaaccaatgaagattgtatgaaatggttggacaccaaggaagccaactccgttgtctacatcgccttcggttctgttgctcgtttgtctgtcgaacaaatggctgaaattgctaaggctttggaccattcttccaagtctttcatctgggttgtcagagaaactgaaaaggaaaagttgccagtcgatttggttgaaaagatctctggtcaaggtatggttgtcccatgggctcctcaattggaagttttggctcacgatgctgtcggttgtttcgtttctcactgtggttggaactccaccattgaagctttgtctttcggtgttccaattttggccatgcctcaattcttagatcaattggtcgatgctcatttcgttgacagagtctggggtgtcggtattgctccaactgtcgatgaaaacgatttggttactcaagaagaaatctccagatgtctagacgaaatgatgggtggtggtccagaaggtgaaaagatcaagaagaacgttgccatgtggaaggaattgaccaaggaagctttggacaagggtggttcctctgacaagcacattgacgaaatcattgaatggttatcttcctcc

SEQ ID NO: 46 - protein, 478 aa, Vaccaria hispanica
MSNNENNATQVIVLPYHGQGHMNTMVQFAKRLAWKGVHVTIATTFNTIQQMKLNISSYNSITLEPIYDDTDDSTLHIKDRMARFEAEAASNLTRVLEAKKQQQALNKKCLLVYHGSLNWALVVAHQQNVAGAAFFTAASASFACYYYLHLESQGKGVDLEELPSILPPPKVIVQKLPKSFLAYGDNNSHNNNNNNNNNNNNNNMGLHPLVLWLLKDYGNSVKADFVLLNSFDKLEEEAIKWISNICSVKTIGPTIPSTYLDKQIENDVDYGFNQYKPTNEDCMKWLDTKEANSVVYIAFGSVARLSVEQMAEIAKALDHSSKSFIWVVRETEKEKLPVDLVEKISGQGMVVPWAPQLEVLAHDAVGCFVSHCGWNSTIEALSFGVPILAMPQFLDQLVDAHFVDRVWGVGIAPTVDENDLVTQEEISRCLDEMMGGGPEGEKIKKNVAMWKELTKEALDKGGSSDKHIDEIIEWLSSS

SEQ ID NO: 47 - DNA, 1443 bp, Streptococcus mutans
  CDS (1)..(1443)
atgccaatcatcaacaagaccatgttgatcacttacgctgactctctaggtaagaacttgaaagaattgaatgaaaacattgaaaactacttcggtgatgctgtcggtggtgttcacttgttgcctttcttcccatccaccggtgacagaggtttcgctccaattgactaccatgaagtcgactccgccttcggtgactgggatgacgttaagtgtttgggtgaaaagtactacttgatgtttgacttcatgatcaaccacatctccagacaatctaagtactacaaggactaccaagaaaagcacgaagcttctgcttacaaggatttgttcttgaactgggacaaattctggccaaagaacagaccaactcaagaagatgtcgacttgatctacaagagaaaggaccgtgccccaaagcaagaaatccaatttgccgatggttctgttgaacacttatggaacactttcggtgaagaacaaatcgatttggatgtcaccaaggaagttaccatggacttcatcagatccaccattgaaaacttggctgctaacggttgtgacttgatcagattggatgctttcgcttacgctgttaagaagctagacaccaacgatttcttcgtcgaaccagaaatctggactttgttggacaaggtccgtgacattgctgctgtttctggtgctgaaattttgccagaaattcacgaacattacactatccaattcaagattgctgaccacgactactacgtttacgactttgctttgccaatggttactttatactctttgtactcctccaaggtcgacagattagctaaatggttgaaaatgtctccaatgaagcaattcaccactttggacacccacgacggtattggtgttgtcgatgtcaaggatatcttgaccgatgaagaaatcacttacacttccaatgaattatacaaggtcggtgccaacgttaacagaaaatactctactgctgaatacaacaacttggatatctaccaaatcaactctacctactactctgctttgggtgacgatgaccaaaagtatttcttggccagattaatccaagctttcgctccaggtatcccacaagtctactacgttggtttcttggccggtaagaacgatttggaattgttggaatccaccaaggaaggtagaaacatcaacagacactactactcttctgaagaaattgctaaggaagtcaaaagaccagttgttaaggctttgttgaacttattcacttacagaaaccaatctgctgcctttgacttggatggtagaattgaagttgaaaccccaaacgaagctaccattgttattgaaagacaaaacaaagatggttcccacattgccaaggctgaaatcaacttgcaagacatgacttaccgtgtcactgaaaacgaccaaaccatttctttcgaa

SEQ ID NO: 48 - protein, 481 aa, Streptococcus mutans
MPIINKTMLITYADSLGKNLKELNENIENYFGDAVGGVHLLPFFPSTGDRGFAPIDYHEVDSAFGDWDDVKCLGEKYYLMFDFMINHISRQSKYYKDYQEKHEASAYKDLFLNWDKFWPKNRPTQEDVDLIYKRKDRAPKQEIQFADGSVEHLWNTFGEEQIDLDVTKEVTMDFIRSTIENLAANGCDLIRLDAFAYAVKKLDTNDFFVEPEIWTLLDKVRDIAAVSGAEILPEIHEHYTIQFKIADHDYYVYDFALPMVTLYSLYSSKVDRLAKWLKMSPMKQFTTLDTHDGIGVVDVKDILTDEEITYTSNELYKVGANVNRKYSTAEYNNLDIYQINSTYYSALGDDDQKYFLARLIQAFAPGIPQVYYVGFLAGKNDLELLESTKEGRNINRHYYSSEEIAKEVKRPVVKALLNLFTYRNQSAAFDLDGRIEVETPNEATIVIERQNKDGSHIAKAEINLQDMTYRVTENDQTISFE

SEQ ID NO: 49 - DNA, 1392 bp, Lobelia erinus
  CDS (1)..(1392)
atggacaacaaccatttgggtgaaactttgttgccattggctccaaagaacggtagaagagtcttgttcttcccatacccattacaaggtcacatttctccaatgttgaacttggccaacttgttgcactccaagggtttcaccatcaccatcatccacaccaatttgaactctccaaaccaatctgactacccacacttcactttcagaccatttgatgacggtttcccaccatactccaagggttggcaattggctaccttgtgttccagatgtgttgaaccattcagagaatgtttggctcaaatcttcttgtctgaccacactgctccagaaggtgaaagagaatctattgcttgtttgattgctgatggtttatggaacttcttgggtgctgctgtctacaactttaaattgccaatgattgttttgagaactggtaacatgtctaacattgttgccaacgttaagttgccatgtttcatcgaaaagggttacttcgaccataccaaggaaggttccaagttggaagctgctgtcccagaattcccaaccatcaagttcaaagatatcttgaaaacctacggttctaacccaaaggccatctgtgaaactttgactgctttgttgaaggaaatgagagcttcttctggtgtcatctggaactcttgtaaggaattagaacaatctgaattacaaatgatctgtaaggaattcccagttcctcatttcttgattggtcctttgcacaaatacttcccagcttcttcttcttccttggttgcccacgacccatcttccatttcctggttgaactccaaggctccaaactctgttttgtacgtttctttcggttccatctcttccatggacgaagctgaatttctagaaactgcttggggtttggccaactccatgcaacaattcttatgggttgtcagaccaggttctgtcagaggttctcaatggttggaatctttaccagatggtttcattgacaagttggatggtagaggtcacattgtcaaatgggctcctcaacaagaagtcttagctcaccaagctaccggtggtttctggactcactgtggttggaactccactttagaatccatgtgtgaaggtgtcccaatgatttgttcccacggtatcatggaccaaccaatcaatgctcgttacgttaccgatgtctggaaggttggtattgaattggaaaagggttttgactctgaagaaatcaagatggccatccgtcgtttgatggttgacaaggaaggtcaagaaatcagagaaagatcttccagattgaaggaatctttgtccaactgtttgaagcaaggtggttcttcccacgattctgtcgaatctttggttgaccacatcctatccttc

SEQ ID NO: 50 - protein, 464 aa, Lobelia erinus
MDNNHLGETLLPLAPKNGRRVLFFPYPLQGHISPMLNLANLLHSKGFTITIIHTNLNSPNQSDYPHFTFRPFDDGFPPYSKGWQLATLCSRCVEPFRECLAQIFLSDHTAPEGERESIACLIADGLWNFLGAAVYNFKLPMIVLRTGNMSNIVANVKLPCFIEKGYFDHTKEGSKLEAAVPEFPTIKFKDILKTYGSNPKAICETLTALLKEMRASSGVIWNSCKELEQSELQMICKEFPVPHFLIGPLHKYFPASSSSLVAHDPSSISWLNSKAPNSVLYVSFGSISSMDEAEFLETAWGLANSMQQFLWVVRPGSVRGSQWLESLPDGFIDKLDGRGHIVKWAPQQEVLAHQATGGFWTHCGWNSTLESMCEGVPMICSHGIMDQPINARYVTDVWKVGIELEKGFDSEEIKMAIRRLMVDKEGQEIRERSSRLKESLSNCLKQGGSSHDSVESLVDHILSF

SEQ ID NO: 51 - DNA, 1380 bp, Arabidopsis thaliana
  CDS (1)..(1380)
atggaagaaagaaagggtagaagaatcatcatgttcccattaccattcccaggtcacttcaacccaatgattgaattggctggtatctttcatcaccgtggtttctccgttaccatcttgcacacttcttacaacttcccagacccatccagacacccacacttcactttcagaaccatttctcacaacaaggaaggtgaagaagatccattatctcaatctgaaacctcttccatggacttgattgtcttggtcagaagattaaagcaacgttacgctgaaccattcagaaagtccgttgctgctgaagtcggtggtggtgaaaccgtttgttgtttggtttctgatgctatctggggtaagaacactgaagttgttgctgaagaaatcggtgtcagaagagttgttttgagaactggtggtgcctcttctttctgtgcctttgctgctttcccattattgagagacaagggttacttgccaatccaagattctcgtttggatgaacctgttactgaattgcctccattgaaggtcaaggacttaccagtcatggaaaccaatgaaccagaagaattgtacagagttgttaacgacatggttgaaggtgctaaatcttcttctggtgtcatctggaacactttcgaagatttggaaagattgtctttgatgaactgttcctccaaattgcaagttccattcttcccaatcggtccattccacaagtactctgaagatccaactccaaagactgaaaacaaggaagataccgactggttggacaagcaagaccctcaatccgttgtctacgcctcctttggttctttggccgctattgaagaaaaggaattcttggaaattgcttggggtctaagaaactctgaaagaccattcttatgggttgttagaccaggttccgtccgtggtactgaatggttggaatctctaccattgggtttcatggaaaacatcggtgacaagggtaagattgtcaaatgggctaaccaattggaagttttggctcacccagccattggtgctttctggacccactgtggttggaactccactttggaatccatctgtgaaggtgtcccaatgatctgtacctcctgttttaccgaccaacatgtcaacgccagatacattgtcgacgtctggagagtcggtatgttgttggaaagatccaagatggaaaagaaggaaatcgaaaaggttttgagatctgttatgatggaaaagggtgatggtttgagagaaagatctttgaaattgaaggaaagagctgatttctgtttgtccaaggacggttcttcttccaagtacttggacaaattggtttcccacgtcttatctttcgactcttacgctttcgcttct

SEQ ID NO: 52 - protein, 460 aa, Arabidopsis thaliana
MEERKGRRIIMFPLPFPGHFNPMIELAGIFHHRGFSVTILHTSYNFPDPSRHPHFTFRTISHNKEGEEDPLSQSETSSMDLIVLVRRLKQRYAEPFRKSVAAEVGGGETVCCLVSDAIWGKNTEVVAEEIGVRRVVLRTGGASSFCAFAAFPLLRDKGYLPIQDSRLDEPVTELPPLKVKDLPVMETNEPEELYRVVNDMVEGAKSSSGVIWNTFEDLERLSLMNCSSKLQVPFFPIGPFHKYSEDPTPKTENKEDTDWLDKQDPQSVVYASFGSLAAIEEKEFLEIAWGLRNSERPFLWVVRPGSVRGTEWLESLPLGFMENIGDKGKIVKWANQLEVLAHPAIGAFWTHCGWNSTLESICEGVPMICTSCFTDQHVNARYIVDVWRVGMLLERSKMEKKEIEKVLRSVMMEKGDGLRERSLKLKERADFCLSKDGSSSKYLDKLVSHVLSFDSYAFAS

SEQ ID NO: 53 - DNA, 2139 bp, Gibberella fujikuroi
  CDS (1)..(2139)
atggctgaattggacactttggatatcgtcgttttgggtgttatcttcttgggtactgttgcttacttcaccaagggtaagttgtggggtgtcaccaaggatccatacgctaacggttttgccgctggtggtgcttccaagccaggtagaaccagaaacattgttgaagccatggaagaatctggtaagaactgtgttgttttctacggttctcaaaccggtactgctgaagattacgcttccagattagctaaggaaggtaagtccagattcggtttgaacaccatgattgctgacttagaagattacgacttcgacaacttggataccgttccatctgacaacattgtcatgttcgttttggctacctacggtgaaggtgaacctaccgacaatgctgttgacttctacgaattcatcactggtgaagatgcttctttcaacgaaggtaacgaccctccattgggtaacttgaattatgtcgctttcggtttaggtaacaacacctacgaacactacaactccatggttagaaatgtcaacaaagctttggaaaagctaggtgcccacagaattggtgaagctggtgaaggtgacgacggtgctggtactatggaagaagatttcttggcttggaaggacccaatgtgggaagctttggctaagaagatgggtttggaagaaagagaagctgtttacgaaccaatctttgctatcaacgaaagagatgacttgactccagaagctaacgaagtttacttgggtgaaccaaataaattgcacttggaaggtactgctaagggtcctttcaactctcacaacccatacattgctccaattgctgaatcttacgaattgttctctgccaaggacagaaactgtttgcacatggaaattgatatctctggttccaacttgaaatacgaaactggtgaccacattgccatctggccaaccaacccaggtgaagaagtcaacaaattcttggatatcttggacttatccggtaagcaacactctgttgttaccgttaaggccttggaaccaactgccaaggtcccattcccaaacccaaccacttacgatgctatcctaagataccacttggaaatctgtgccccagtttcccgtcaatttgtctctactttggctgcctttgctccaaacgacgacatcaaggctgaaatgaacagattgggttctgacaaggactacttccatgaaaagactggtccacactactacaacattgccagattcttagcttccgtttctaagggtgaaaagtggaccaagattccattttccgctttcatcgaaggtttgaccaaattacaaccaagatactactccatctcctcttcttctttggtccaaccaaagaagatctccatcactgccgtcgttgaatctcaacaaattccaggtagagatgacccattcagaggtgtcgccaccaactacttgttcgctttgaagcaaaagcaaaacggtgacccaaacccagctccattcggtcaatcttacgaattgaccggtccaagaaacaaatacgatggtattcatgttccagtccacgtcagacactccaactttaaattgccttctgacccaggtaagccaatcatcatgatcggtccaggtactggtgttgctccattcagaggtttcgttcaagaaagagccaagcaagctagagatggtgtcgaagtcggtaagactttgttattcttcggttgtcgtaaatctactgaagatttcatgtaccaaaaggaatggcaagaatacaaagaagctttgggtgacaagttcgaaatgatcactgctttctccagagaaggttccaagaaggtttacgtccaacatcgtttgaaggaaagatccaaggaagtttccgacttgttgtctcaaaaggcctacttctacgtttgtggtgacgctgctcacatggctcgtgaagtcaacaccgtcttggctcaaatcattgctgaaggtagaggtgtctctgaagctaagggtgaagaaattgtcaagaacatgagatctgccaaccaataccaagtttgttctgatttcgttactttacactgtaaggaaaccacctacgctaactctgaattgcaagaagatgtctggtct

SEQ ID NO: 54 - protein, 713 aa, Gibberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 55 - DNA, 2076 bp, Arabidopsis thaliana
  CDS (1)..(2076)
atgacctctgctttatacgcctccgatttgttcaagcaattgaagtccatcatgggtactgactctttgtccgatgatgttgtcttagtcattgccaccacttctttggctttggttgctggtttcgttgtcttgttgtggaagaaaaccaccgctgacagatccggtgaattgaaacctttgatgattccaaagtctttgatggccaaggacgaagatgacgacttggacttgggttctggtaagaccagagtctccattttcttcggtactcaaaccggtactgctgaaggtttcgctaaggctttgtctgaagaaattaaagccagatacgaaaaggctgccgttaaggttatcgatttggatgactacgctgctgacgatgaccaatacgaagaaaagttgaagaaggaaactttggctttcttctgtgttgctacctacggtgacggtgaaccaactgacaatgctgctagattctacaagtggttcaccgaagaaaacgaaagagacatcaaattgcaacaattggcttacggtgtctttgctttgggtaacagacaatacgaacatttcaacaagatcggtattgtcttggacgaagaattatgtaagaagggtgccaagagattgattgaagtcggtttgggtgacgatgaccaatctattgaagatgacttcaacgcttggaaggaatctttgtggtctgaattagacaagttattgaaggacgaagatgacaagtccgttgctactccatacactgctgtcatcccagaataccgtgtcgtcacccacgacccaagattcaccacccaaaagtccatggaatccaacgttgccaacggtaacaccactattgacatccaccacccatgtcgtgttgatgttgctgttcaaaaggaattgcacacccacgaatctgaccgttcttgtattcacttggaattcgatatctccagaaccggtatcacttacgaaactggtgaccacgtcggtgtctacgctgaaaaccacgttgaaatcgtcgaagaagccggtaaattgttgggtcactctttggacttggttttctccatccacgctgacaaggaagatggttctccattagaatccgccgtcccacctccattcccaggtccatgtaccttaggtactggtctagctcgttacgctgatttgttgaacccaccaagaaagtctgctttggttgctttggctgcttacgctactgaaccttctgaagctgaaaagttgaagcatttgacttctccagacggtaaggatgaatactcccaatggatcgttgcttctcaaagatctctattggaagttatggctgctttcccatctgccaagccaccattgggtgttttctttgctgccattgctccaagattgcaaccaagatactactccatttcttcttctccaagattggctccatctagagtccacgtcacctctgctttggtttacggtccaactccaaccggtagaatccacaaaggtgtttgttccacctggatgaagaacgctgttccagctgaaaagtcccacgaatgttccggtgctccaatctttatcagagcttctaacttcaagttgccatccaacccatctactccaatcgtcatggttggtccaggtactggtttggctccattcagaggtttcttacaagaaagaatggctttgaaagaagatggtgaagaattgggttcttctctattgttcttcggttgtagaaacagacaaatggacttcatctacgaagatgaattaaacaactttgtcgaccaaggtgttatctccgaattgatcatggccttctctagagaaggtgctcaaaaggaatacgttcaacataaaatgatggaaaaggctgctcaagtttgggacttgatcaaggaagaaggttacttgtacgtttgtggtgatgccaaaggtatggccagagatgtccacagaactttgcacaccattgtccaagaacaagaaggtgtttcctcttccgaagctgaagccattgtcaagaagttacaaactgaaggtcgttatttgagagatgtctgg

SEQ ID NO: 56 - protein, 692 aa, Arabidopsis thaliana [sequence omitted]

SEQ ID NO: 57 - DNA, 2133 bp, Arabidopsis thaliana
  CDS (1)..(2133)
atgtcctcttcttcttcttcttctacttccatgattgatttgatggctgccatcatcaagggtgaaccagtcattgtctctgacccagccaacgcttctgcttacgaatccgttgctgctgaattgtcctccatgttgattgaaaacagacaattcgctatgattgtcactacttccattgctgtcttgattggttgtatcgtcatgttggtctggagaagatccggttccggtaactccaagagagttgaaccattgaagccattagtcatcaagccaagagaagaagaaattgatgacggtagaaagaaggtcaccatcttctttggtactcaaaccggtactgctgaaggttttgctaaggctttgggtgaagaagccaaagctagatacgaaaagaccagattcaagatcgttgacttggacgactacgctgctgatgacgacgaatacgaagaaaagttgaagaaggaagatgttgccttcttcttcttggctacttacggtgatggtgaaccaactgacaatgctgccagattctacaaatggttcaccgaaggtaacgacagaggtgaatggttaaagaacttgaaatacggtgttttcggtctaggtaacagacaatacgaacacttcaacaaggttgccaaggttgtcgatgacatcttggttgaacaaggtgctcaaagattagtccaagtcggtttgggtgatgatgaccaatgtatcgaagatgacttcactgcttggagagaagctttgtggccagaattggacaccatcttaagagaagaaggtgataccgctgttgccaccccatacactgctgctgttttggaatacagagtttctatccacgactctgaagatgccaagttcaacgacatcaacatggctaacggtaacggttacactgttttcgacgctcaacacccatacaaggccaatgttgctgtcaagagagaattgcacactccagaatctgatcgttcttgtatccacttggaatttgacattgctggttctggtttgacctacgaaaccggtgaccacgtcggtgtcttatgtgacaacttgtctgaaactgtcgatgaagctttgagattattggacatgtctccagacacttatttctccttgcatgctgaaaaggaagatggtactccaatttcttcttccttgcctcctccattcccaccatgtaacttgagaaccgctttaaccagatacgcttgtttgctatcctctccaaagaagtccgctttggttgctttggctgctcacgcttctgacccaactgaagctgaaagattgaaacatttggcttccccagctggtaaggatgaatactccaaatgggttgttgaatctcaaagatctttgttggaagtcatggctgaattcccatctgccaagccaccattgggtgttttcttcgccggtgttgctccaagattgcaaccaagattttactccatctcttcttctccaaagattgctgaaaccagaattcacgttacctgtgccttggtctacgaaaagatgccaaccggtagaattcacaagggtgtttgttccacctggatgaagaacgctgttccatacgaaaagtctgaaaactgttcttctgctccaatcttcgtccgtcaatccaacttcaagttgccatctgactccaaggtcccaatcatcatgatcggtccaggtactggtttagctccattcagaggtttcttgcaagaaagattggccttagttgaatctggtgtcgaattgggtccttctgttttgttcttcggttgtagaaaccgtcgtatggacttcatctacgaagaagaattgcaaagatttgtcgaatctggtgctttggctgaattgtccgttgctttctctcgtgaaggtccaaccaaagaatacgttcaacacaagatgatggacaaagcctccgacatctggaacatgatctcccaaggtgcttacttgtacgtttgtggtgatgctaaaggtatggccagagatgtccacagatctttacataccattgcccaagaacaaggttccatggactccaccaaggctgaaggtttcgttaagaacttgcaaacttctggtcgttacttgagagatgtttgg

SEQ ID NO: 58 - protein, 711 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDINMANGNGYTVFDAQHPYKANVAVKRELHTPESDRSCIHLEFDIAGSGLTYETGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSENCSSAPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 59 - DNA, 2361 bp, Stevia rebaudiana
  CDS (1)..(2361)
atgaagactggtttcatctctccagctaccgtcttccaccacagaatctctccagctaccactttcagacaccacttgtccccagctaccactaactctactggtattgttgctttgagagacatcaacttcagatgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 60 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 61 - DNA, 2229 bp, Stevia rebaudiana
  CDS (1)..(2229)
atgtgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 62 - protein, 743 aa, Stevia rebaudiana
MCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 63 - DNA, 2352 bp, Stevia rebaudiana
  CDS (1)..(2352)
atgaacttgtctctatgtattgcttctccattattgaccaaatctaacagaccagccgctctatccgctattcacactgcctccacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 64 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 65 - DNA, 2271 bp, Stevia rebaudiana
  CDS (1)..(2271)
atgacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 66 - protein, 757 aa, Stevia rebaudiana
MTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 67 - DNA, 1539 bp, Stevia rebaudiana
  CDS (1)..(1539)
atggatgctgtcactggtttgttgaccgtcccagctaccgccatcaccattggtggtactgctgttgctttggctgttgctttgatcttctggtacttgaaatcttacacttctgccagaagatctcaatctaaccatttaccaagagttccagaagttccaggtgttccattgttgggtaacttgttgcaattgaaagaaaagaagccttacatgactttcaccagatgggctgctacctacggtccaatttactctatcaagaccggtgctacctccatggttgttgtttcctccaacgaaattgccaaggaagctttagtcaccagattccaatccatctctaccagaaacttgtccaaggctttgaaggtcttgactgctgacaagaccatggttgccatgtctgactacgatgactaccacaagactgtcaaacgtcacatcttgactgctgttttgggtccaaatgctcaaaagaagcacagaattcacagagatatcatgatggacaacatctctactcaattgcatgaatttgtcaagaacaacccagaacaagaagaagtcgatttgagaaagatcttccaatctgaattgttcggtttggccatgagacaagctttgggtaaagatgtcgaatctttatacgtcgaagatttgaagatcaccatgaacagagatgaaatcttccaagttttggttgtcgacccaatgatgggtgccattgatgttgactggagagatttcttcccatacttgaaatgggttccaaacaagaagttcgaaaataccattcaacaaatgtacatccgtcgtgaagctgtcatgaagtctttaatcaaggaaaacaagaagagaattgcttctggtgaaaagttaaactcctacattgactatttgttgtccgaagctcaaactttgactgaccaacaattattgatgtctttatgggaaccaatcattgaatcttctgacaccaccatggtcactactgaatgggctatgtacgaattggccaagaacccaaaattacaagaccgtttgtacagagatatcaaatccgtctgtggttccgaaaagatcactgaagaacacttgtctcaattgccatacatcactgctatcttccacgaaactttgagaagacactctccagttccaatcattccattgagacacgtccacgaagacactgttttgggtggttaccacgttccagctggtactgaattggctgtcaacatctacggttgtaacatggacaagaacgtctgggaaaacccagaagaatggaacccagaaagattcatgaaggaaaacgaaaccattgacttccaaaagaccatggctttcggtggtggtaagagagtttgtgccggttccttgcaagctctattgaccgcttccattggtattggtagaatggttcaagaatttgaatggaagttgaaggacatgacccaagaagaagttaacaccattggtttgactactcaaatgttaagaccattgagagccatcatcaagcctcgcatc

SEQ ID NO: 68 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKENKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 69 - DNA, 1566 bp, Stevia rebaudiana
  CDS (1)..(1566)
atgggtttgttcccattggaagactcttacgctttggttttcgaaggtttggccatcactttggctttgtactacctattgtctttcatctacaagacctccaagaagacctgtaccccaccaaaggcttctggtgaacacccaattaccggtcatttaaacttgttgtctggttcttccggtttgccacacttggctttggcttctttggctgacagatgtggtcctatcttcaccatcagattaggtatcagaagagttttggttgtttccaactgggaaattgccaaggaaatctttaccacccacgacttgattgtctccaacagaccaaagtacttggctgccaagatcttaggtttcaactacgtttctttctctttcgctccatacggtccatactgggttggtatcagaaagattattgctactaaattgatgtcttcttctagattgcaaaagttgcaattcgtccgtgtctttgaattggaaaactccatgaaatccatcagagaatcctggaaggaaaagaaggatgaagaaggtaaggtcttggttgaaatgaagaagtggttctgggaattgaatatgaacattgtcttgagaaccgttgctggtaagcaatacactggtactgttgacgatgctgatgccaagagaatttctgaattgttcagagaatggttccactacactggtagattcgttgtcggtgatgctttcccatttctaggttggttggatttaggtggttacaagaagaccatggaattggttgcctccagattagattccatggtcagcaaatggttggacgaacacagaaagaagcaagctaacgatgacaagaaggaagacatggacttcatggacatcatgatctccatgactgaagctaactctccattggaaggttacggtactgacaccatcatcaagaccacttgtatgactttgattgtttccggtgtcgacaccacttctatcgttttgacctgggctttgtctttgttgttgaacaacagagacactttaaagaaggctcaagaagaattggacatgtgtgtcggtaagggtagacaagtcaatgaatctgatttggtcaacttaatctatttagaagctgtcttgaaagaagctttgagattgtacccagctgctttcttgggtggtcctcgtgctttcttggaagactgtaccgttgccggttacagaattccaaagggtacttgtttgttgatcaacatgtggaaattgcacagagatccaaacatctggtctgacccatgtgaattcaaaccagaaagattcttgactccaaaccaaaaggatgttgatgtcattggtatggacttcgaattgattccattcggtgctggtcgtcgttactgtccaggtaccagattagctttgcaaatgttgcacattgtcttggccactctattacaaaactttgaaatgtccactccaaacgatgctccagttgacatgactgcttccgttggtatgaccaacgccaaggcttctccattggaagttttgttgtctccaagagtcaaatggtct

SEQ ID NO: 70 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 71 - DNA, 1443 bp, Stevia rebaudiana
  CDS (1)..(1443)
atggacgctatggccaccactgaaaagaagcctcacgttatctttattccattcccagctcaatctcatatcaaggctatgttgaaattggctcaattattgcaccacaagggtttgcaaatcacttttgtcaacaccgacttcattcacaaccaattcttggaatcttctggtcctcactgtttggacggtgctccaggtttcagattcgaaaccattccagatggtgtttcccactctccagaagcctccatcccaatcagagaatccttgttgagatctattgaaaccaacttcttggaccgtttcatcgatttggttaccaaattgccagacccaccaacctgtatcatttctgacggtttcttgtccgttttcaccatcgatgctgccaagaaattgggtattccagtcatgatgtactggactttggctgcttgtggtttcatgggtttctaccatattcactctttgattgaaaagggtttcgctccattaaaggatgcttcttacttgaccaacggttacttggacaccgtcattgactgggttccaggtatggaaggtatcagattgaaagatttcccattggactggtctactgacttgaatgacaaggtcttgatgttcactactgaagctccacaaagatctcataaggtttctcaccacatcttccacactttcgatgaattagaaccatctatcatcaagactctatccttgagatacaaccatatctacaccattggtccattacaattgttgttggaccaaatcccagaagaaaagaagcaaaccggtatcacttctttgcacggttactctttagtcaaggaagaaccagaatgtttccaatggttacaatccaaggaaccaaactctgttgtctacgttaactttggttccaccactgttatgtccttggaagatatgactgaatttggttggggtttggctaactctaaccactacttcttatggatcatcagatctaacttggtcattggtgaaaacgccgttttgcctccagaattggaagaacacatcaagaagagaggtttcattgcttcctggtgttctcaagaaaaggtcttgaagcacccatctgttggtggtttcttgacccactgtggttggggttccaccattgaatccctatctgctggtgttccaatgatctgttggccatactcctgggaccaattgactaactgtcgttacatctgtaaggaatgggaagttggtttggaaatgggtactaaggtcaagagagatgaagtcaagagattagtccaagaattgatgggtgaaggtggtcacaagatgagaaacaaagccaaggactggaaggaaaaggccagaattgctattgctccaaacggttcttcctccttgaacatcgataaaatggttaaggaaatcactgtcttggctcgaaac

SEQ ID NO: 72 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 73 - DNA, 1380 bp, Stevia rebaudiana
  CDS (1)..(1380)
atggctgaacaacaaaagatcaagaaatctccacacgtcttgttgattccattcccattgcaaggtcacatcaacccattcatccaattcggtaagagattgatttccaagggtgtcaagaccactttagtcaccactattcacactttaaactccactttaaaccactctaacactactaccacctctattgaaatccaagccatttctgacggttgtgacgaaggtggtttcatgtctgctggtgaatcttacttggaaactttcaagcaagtcggttccaagtctttggctgatttgatcaagaaattgcaatccgaaggtactaccatcgatgctatcatctacgactccatgactgaatgggttttggatgttgccattgaatttggtattgacggtggttctttcttcacccaagcctgtgttgttaactctttgtactaccacgtccacaagggtttgatctctctaccattaggtgaaaccgtttccgtcccaggtttcccagtcttgcaaagatgggaaactccattgatcttacaaaaccatgaacaaatccaatctccatggtcccaaatgttgtttggtcaattcgctaacattgaccaagctagatgggttttcaccaactctttctacaagttggaagaagaagtcattgaatggaccagaaagatctggaacttgaaggttatcggtccaactctaccatccatgtacttggacaagagattggatgacgacaaggacaacggtttcaacttgtacaaggctaaccatcacgaatgtatgaactggttggatgacaagccaaaggaatctgttgtttacgttgctttcggttctttggtcaagcatggtccagaacaagttgaagaaatcaccagagctttgattgactccgatgttaacttcttatgggttatcaagcacaaggaagaaggtaaattgccagaaaacttgtctgaagttatcaagaccggtaagggtttgattgttgcttggtgtaagcaattggatgttttggctcacgaatccgtcggttgtttcgtcactcactgtggtttcaactctactttggaagctatctccttgggtgttccagttgttgccatgcctcaattctctgaccaaaccaccaacgccaaattgttggatgaaatcttgggtgtcggtgtccgtgtcaaggctgatgaaaacggtattgttagaagaggtaacttagcttcctgtatcaagatgatcatggaagaagaacgtggtgtcattatcagaaagaatgctgtcaaatggaaggacttggctaaggttgctgtccacgaaggtggttcctctgacaatgacattgttgaatttgtctctgaattgatcaaagcg

SEQ ID NO: 74 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 75 - DNA, 1374 bp, Stevia rebaudiana
  CDS (1)..(1374)
atggaaaacaagactgaaaccactgttagaagaagaagaagaatcatcttattcccagttccattccaaggtcacattaacccaatcttgcaattggctaacgtcttatactccaagggtttctccatcaccatcttccacaccaacttcaacaaacctaaaacttccaactacccacacttcaccttcagatttatcttggacaacgacccacaagatgaaagaatttctaacttgccaacccatggtccattggccggtatgagaattccaatcatcaacgaacacggtgctgacgaattgagaagagaattggaattgttgatgttggcttctgaagaagatgaagaagtctcttgtttgatcactgatgctttatggtactttgctcaatctgttgctgactctttgaacttgagaagattagtcttgatgacctcttctttgttcaacttccacgctcacgtttctctaccacaatttgatgaattgggttacttggacccagatgacaagaccagattggaagaacaagcctccggtttcccaatgttgaaggtcaaggatatcaagtctgcctactccaactggcaaatcttgaaggaaattttgggtaagatgatcaagcaaaccaaggcttcttctggtgtcatctggaactccttcaaggaattggaagaatctgaattggaaaccgtcatcagagaaattccagctccatctttcttgattccattaccaaagcatttgactgcttcctcctcttctctattggaccacgacagaactgttttccaatggttggaccaacaaccaccatcttccgtcttatacgtttcctttggttccacttctgaagttgacgaaaaggacttcttggaaattgctcgtggtttggttgactccaagcaatctttcttatgggttgtcagaccaggtttcgtcaagggttccacctgggttgaacctttgccagacggtttcttgggtgaaagaggtagaattgtcaaatgggttccacaacaagaagttttggctcacggtgccattggtgctttctggactcactctggttggaactctactttggaatccgtttgtgaaggtgttccaatgattttctctgacttcggtttggaccaaccattgaatgctcgttacatgtccgatgttttgaaggttggtgtctacttggaaaacggttgggaacgtggtgaaattgctaacgccatcagaagagtcatggtcgatgaagaaggtgaatacatcagacaaaatgctcgtgtcttgaaacaaaaggctgatgtttctttgatgaagggtggttcttcttacgaatctttggaatctttggtttcctacatctccagtctc

SEQ ID NO: 76 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 77 - DNA, 2130 bp, Stevia rebaudiana
  CDS (1)..(2130)
atgcaatctgattccgttaaggtttctccattcgacttagtctctgctgccatgaacggtaaggctatggaaaagttgaacgcttctgaatctgaggacccaactactttaccagctttaaagatgttggttgaaaacagagaattgttgactttattcaccacctcctttgctgtcttgattggttgtttggttttcttgatgtggagaagatcttcttctaagaagttggttcaagacccagttcctcaagtcatcgtcgtcaagaagaaggaaaaggaatctgaagtcgatgacggtaagaagaaagtttccatcttctacggtactcaaaccggtactgctgaaggtttcgctaaagctttagttgaagaagctaaggtcagatacgaaaagacctctttcaaggttatcgatttggacgactacgccgctgacgacgacgaatacgaagaaaagttgaagaaggaatctctagctttcttcttcttggctacctacggtgacggtgaaccaaccgacaatgctgccaacttctacaaatggttcaccgaaggtgatgacaagggtgaatggttgaagaaattgcaatacggtgttttcggtttaggtaacagacaatacgaacacttcaacaagattgccatcgtcgttgatgacaaattgactgaaatgggtgccaagagattggttccagtcggtttgggtgatgatgaccaatgtattgaagatgactttaccgcttggaaggaattagtttggccagaattagaccaattgttgagagatgaagatgacacctctgttaccaccccatacaccgccgctgtcttggaataccgtgtcgtttaccatgacaaaccagctgactcttacgctgaagatcaaacccacaccaacggtcacgttgtccacgacgctcaacacccatccagatctaacgttgctttcaagaaggaattgcacacttcccaatctgatcgttcttgtacccacttggaatttgacatctcccacaccggtttgtcttacgaaaccggtgaccatgttggtgtctactctgaaaacttgtctgaagttgtcgacgaagctttgaaattgttgggtttgtctccagacacttacttctccgtccacgctgacaaagaagatggtactccaatcggtggtgcttctttgcctccaccattcccaccatgtactctaagagatgctttgacccgttatgctgacgttctatcctctccaaagaaggttgctttgttggctttggctgctcatgcttctgatccatctgaagctgacagattgaagttcttggcttccccagccggtaaggacgaatacgctcaatggattgttgccaaccaaagatccttgttggaagtcatgcaatctttcccatctgccaagcctccattgggtgttttctttgccgctgttgccccaagattgcaaccaagatactactccatctcctcttctccaaagatgtccccaaacagaattcacgtcacttgtgctttggtttacgaaaccactccagctggtagaattcacagaggtttgtgttccacctggatgaagaatgccgtcccattaactgaatctccagactgttcccaagcttctatcttcgtcagaacttccaacttcagattgccagtcgatccaaaggtcccagttatcatgatcggtccaggtactggtttggctccattcagaggtttcttgcaagaaagattagctttgaaagaatctggtactgaattgggttcctccatcttcttcttcggttgtagaaacagaaaggtcgattttatctacgaagatgaattgaacaacttcgttgaaactggtgctttgtctgaattgattgtcgctttctccagagaaggtactgccaaggaatacgtccaacacaagatgtcccaaaaggcttctgatatctggaagttgttgtctgaaggtgcttacttgtacgtttgtggtgatgctaaaggtatggccaaggacgttcacagaactttgcacactattgttcaagaacaaggttctttggactcctccaaggctgaattatacgtcaagaacttgcaaatgtccggtcgttacttgagagatgtatgg

SEQ ID NO: 78 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 79 - DNA, 1575 bp, Saccharomyces cerevisiae
  CDS (1)..(1575)
atggaccaattggtcaagactgaagtcaccaagaaatctttcactgctccagtccaaaaggcttccactccagttttgaccaacaagaccgtcatctccggttccaaggttaaatctttgtcctctgctcaatcttcctcctctggtccatcttcttcttctgaagaagatgattccagagatatcgaatctttggacaagaaaatcagaccattggaagaattggaagctctattgtcctctggtaacactaagcaattaaagaacaaggaagttgctgctttggttatccacggtaaattgccattgtacgctttggaaaagaaattaggtgacaccaccagagctgttgctgtcagaagaaaggctttgtccattttggctgaagctccagtcttggcttccgacagattaccatacaagaactacgactacgaccgtgtctttggtgcttgttgtgaaaatgtcattggttacatgccattaccagttggtgtcattggtccattggttatcgacggtacttcttaccacatcccaatggctaccactgaaggttgtttggttgcttctgccatgagaggttgtaaggccatcaacgctggtggtggtgctaccaccgttttgactaaggatggtatgaccagaggtcctgttgtcagattcccaactttgaagagatctggtgcttgtaagatctggttggattctgaagaaggtcaaaacgccatcaagaaggctttcaactccacttccagattcgctagattgcaacacattcaaacttgtttagctggtgacttgttgttcatgagattcagaaccaccactggtgacgctatgggtatgaacatgatctccaagggtgttgaatactctttgaagcaaatggttgaagaatacggttgggaagatatggaagttgtctctgtttctggtaactactgtaccgacaagaagccagctgccatcaactggatcgaaggtcgtggtaagtccgttgttgctgaagctaccattccaggtgacgttgtcagaaaggttttgaaatctgatgtttctgctttagtcgaattgaacattgccaagaacttggtcggttctgccatggctggttccgtcggtggtttcaacgctcatgccgctaacttggtcactgctgttttcttggctttaggtcaagatccagctcaaaatgtcgaatcctctaactgtatcactttgatgaaggaagttgacggtgatttgagaatttctgtttccatgccatccattgaagtcggtactatcggtggtggtactgtcttggaaccacaaggtgccatgttggacttgttgggtgttcgtggtccacacgctaccgctccaggtactaacgccagacaattggccagaattgttgcctgtgccgtcttggctggtgaattgtctctatgtgccgctttggctgctggtcacttggttcaatctcacatgacccacaacagaaagcctgctgaaccaaccaaaccaaacaacttggatgctactgacattaacagattaaaggacggttctgtcacctgtatcaagtct

SEQ ID NO: 80 - protein, 525 aa, Saccharomyces cerevisiae
MDQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 81 - DNA, 1056 bp, Saccharomyces cerevisiae
  CDS (1)..(1056)
atggcttctgaaaaggaaatcagaagagaacgtttcttgaatgttttcccaaaattggttgaagaattgaacgcttctctattagcttacggtatgccaaaggaagcttgtgactggtacgctcactctttgaactacaacaccccaggtggtaagttgaacagaggtctatccgttgttgacacctacgccattttgtccaacaagaccgtcgaacaattaggtcaagaagaatacgaaaaggttgccatcttaggttggtgtatcgaattgttgcaagcttacttcttggttgctgatgacatgatggacaaatctatcaccagaagaggtcaaccatgttggtacaaggttccagaagtcggtgaaattgccatcaacgatgctttcatgttggaagctgccatctacaagttgttgaagtctcacttcagaaacgaaaagtactacattgacatcactgaattattccacgaagttactttccaaaccgaattgggtcaattgatggacttgattaccgctccagaagataaggtcgatttgtccaaattttccttgaagaaacactctttcattgtcactttcaagactgcttactactccttttacttgcctgttgctttggccatgtatgtcgctggtatcaccgatgaaaaggacttgaagcaagctcgtgatgtcttgattccattaggtgaatacttccaaatccaagatgactacttggactgtttcggtactccagaacaaatcggtaagattggtactgatatccaagacaacaagtgttcctgggttatcaacaaggctttggaattggcttctgctgaacaaagaaagactttggacgaaaactacggtaagaaggactctgttgctgaagctaagtgtaagaagatcttcaacgatttgaaaattgaacaattataccatgaatacgaagaatctattgccaaggacttgaaagccaagatctctcaagtcgacgaatccagaggtttcaaggctgatgtcttgactgctttcttgaacaaggtctacaagagatcaaaa

SEQ ID NO: 82 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 83 - DNA, 1005 bp, Saccharomyces cerevisiae
  CDS (1)..(1005)
atggaagctaagattgacgaattgatcaacaacgaccctgtctggtcctctcaaaacgaatctttgatctccaagccatacaaccacatcttgttgaagccaggtaagaacttcagattaaacttgattgttcaaatcaacagagttatgaacttgccaaaggaccaattggccattgtttcccaaattgtcgaattgttgcacaactcctctctattgatcgatgacattgaagataatgctccattaagaagaggtcaaaccacttctcatttgattttcggtgtcccatccaccatcaacactgctaactacatgtacttcagagccatgcaattggtttctcaattgaccaccaaggaaccattataccacaacttgatcactatctttaacgaagaattgattaacttgcaccgtggtcaaggtttggacatctactggagagatttcttgccagaaattattccaactcaagaaatgtacttgaacatggtcatgaacaagactggtggtttattcagattgactttacgtttgatggaagctttgtctccatcttcccaccacggtcactctttggttccattcatcaatctattaggtatcatctaccaaatcagagatgattacttgaacttgaaggacttccaaatgtcctctgaaaagggtttcgctgaagatatcactgaaggtaaattgtctttcccaattgtccacgccttgaactttaccaagaccaagggtcaaactgaacaacacaacgaaattttgagaatcttattgttgagaacttctgacaaggacatcaagttgaaattgatccaaatcttggaattcgataccaactctttggcttacaccaagaacttcatcaaccaattggttaacatgatcaagaatgacaacgaaaacaaatacttgccagacttggcttcccactccgataccgctaccaacttgcacgacgaattgttgtacattattgaccatttgtctgagtta

SEQ ID NO: 84 - protein, 335 aa, Saccharomyces cerevisiae [sequence omitted]

SEQ ID NO: 85 - DNA, 1575 bp, Gibberella fujikuroi
  CDS (1)..(1575)
atgtccaagtctaactccatgaactccacttctcacgaaactttattccaacaattggttttgggtttggacagaatgccattgatggatgtccactggttgatctacgttgctttcggtgcttggttatgttcctacgtcattcacgttttgtcctcttcttctaccgtcaaggttccagttgtcggttacagatccgttttcgaaccaacctggttattgagattaagatttgtctgggaaggtggttccattattggtcaaggttacaacaaattcaaggactctatcttccaagtcagaaagttgggtactgacattgttatcatcccaccaaactacatcgatgaagtcagaaagttgtcccaagacaagaccagatctgttgaaccattcatcaacgatttcgctggtcaatacaccagaggtatggtctttctacaatctgatttgcaaaaccgtgtcatccaacaaagattgactccaaagttggtttctttgactaaggtcatgaaggaagaattggactacgctttgaccaaggaaatgccagacatgaagaacgacgaatgggttgaagttgacatttcttccatcatggtcagattgatctccagaatctctgcccgtgttttcttgggtccagaacactgtcgtaaccaagaatggttgaccaccactgctgaatactctgaatctttattcatcactggtttcatcttgagagttgtcccacacatcttaagaccattcattgctccattgttgccttcttacagaactttgttgagaaatgtctcttctggtagaagagttatcggtgatatcatcagatctcaacaaggtgatggtaacgaagatatcttgtcctggatgagagatgctgctaccggtgaagaaaagcaaattgacaacattgctcaaagaatgttgatcttgtctttggcttccattcacaccaccgccatgaccatgacccatgccatgtacgacttgtgtgcctgtccagaatacattgaaccattacgtgacgaagtcaaatccgttgttggtgcttctggttgggacaagactgctttgaacagattccacaagttggactctttcttgaaggaatctcaaagattcaacccagttttcttgttgactttcaacagaatctaccatcaatccatgactttgtccgatggtaccaacattccatctggtaccagaattgctgttccatctcacgctatgttgcaagattctgctcacgttccaggtccaactcctccaactgaatttgacggtttcagatactccaagatcagatctgactctaactatgctcaaaagtacttgttctccatgaccgattcttccaacatggctttcggttacggtaagtacgcttgtccaggtcgtttctacgcctccaacgaaatgaaattgactttggccattttgttgttgcaatttgaattcaaattgccagatggtaagggtagaccaagaaacatcactatcgactctgacatgattccagacccaagagctagattatgtgtcagaaagagatctctacgtgacgaa

SEQ ID NO: 86 - protein, 525 aa, Gibberella fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 87 - DNA, 1419 bp, Stevia rebaudiana
  CDS (1)..(1419)
atggccacttctgactccatcgttgatgacagaaagcaattgcacgttgctactttcccatggttagctttcggtcacattttgccatacttgcaattgtccaaattgattgctgaaaagggtcacaaagtctctttcttgtccaccaccagaaacatccaaagattatcttctcacatttctccattgatcaacgttgtccaattgactttaccaagagttcaagaattgccagaagatgctgaagctaccaccgatgtccatccagaagatatcccatacttgaagaaggcttctgatggtttgcaaccagaagtcactagattcttggaacaacactctccagactggattatctacgactacactcactactggttaccatccattgctgcctctttgggtatctctcgtgctcatttctccgttaccactccatgggctattgcttacatgggtccatctgctgatgctatgatcaacggttctgatggtagaaccactgtcgaagacttgaccactccaccaaaatggttcccattcccaaccaaggtctgttggagaaagcacgatttggccagattagttccatacaaggccccaggtatctctgacggttacagaatgggtttagtcttgaagggttctgactgtttgttgtccaagtgttaccatgaattcggtactcaatggttacctttgttggaaactttgcaccaagtcccagttgttccagttggtttgttgcctcctgaaatcccaggtgacgaaaaggacgaaacctgggtttccatcaagaaatggttagatggtaagcaaaagggttccgttgtctacgttgctttgggttctgaagtcttggtttctcaaactgaagttgttgaattggctttgggtttggaattgtccggtctaccatttgtctgggcttacagaaagccaaagggtccagctaagtctgactctgttgaattgccagatggtttcgtcgaaagaaccagagacagaggtttggtctggacttcctgggctccacaattgagaattttgtcccacgaatctgtttgtggtttcttgacccactgtggttctggttccattgtcgaaggtttgatgttcggtcacccattgatcatgttgccaatcttcggtgaccaaccattgaacgctagattattggaagacaagcaagtcggtattgaaatcccaagaaacgaagaagacggttgtttgaccaaggaatctgttgcccgttctctaagatctgttgttgtcgaaaaggaaggtgaaatctacaaggctaacgctagagaattgtccaagatctacaacgataccaaggtcgaaaaggaatatgtctcccaatttgttgactacttggaaaagaacgctcgtgccgttgccattgaccacgaaagc

SEQ ID NO: 88 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 89 - DNA, 1575 bp, Stevia rebaudiana
  CDS (1)..(1575)
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagatgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcc

SEQ ID NO: 90 - protein, 525 aa, Stevia rebaudiana
MGLFPLEDSYALVFEGLAITLALYYLLSFIYKTSKKTCTPPKASGEIIPITGIILNLLSGSSGLPIILALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 91 - DNA, 1428 bp, Stevia rebaudiana
  CDS (1)..(1428)
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagatgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtc

SEQ ID NO: 92 - protein, 476 aa, Stevia rebaudiana; identical to SEQ ID NO: 32

SEQ ID NO: 93 - DNA, 1575 bp, Arabidopsis thaliana
  CDS (1)..(1575)
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtttcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtt

SEQ ID NO: 94 - protein, 525 aa, Arabidopsis thaliana; identical to SEQ ID NO: 34

SEQ ID NO: 95 - DNA, 1587 bp, Vitis vinifera
  CDS (1)..(1587)
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatt

SEQ ID NO: 96 - protein, 529 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSLNCFNLMKI

SEQ ID NO: 97 - DNA, 1437 bp, Medicago truncatula
  CDS (1)..(1437)
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagct

SEQ ID NO: 98 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 99 - DNA, 1419 bp, Stevia rebaudiana
  CDS (1)..(1419)
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcc

SEQ ID NO: 100 - protein, 473 aa, Stevia rebaudiana; identical to SEQ ID NO: 88

SEQ ID NO: 101 - DNA, 1377 bp, Ipomoea purpurea
  CDS (1)..(1377)
atgggttctcaagctaccacctaccacatggccatgtacccatggttcggtgtcggtcatttgactggtttcttcagattggctaacaagttggctggtaagggtcacagaatctctttcttgattccaaagaacactcaatccaaattggaatctttcaacttgcacccacatttgatctctttcgttccaattgttgttccatccattccaggtctaccaccaggtgctgaaaccacctctgatgtcccattcccatctacccatttgttgatggaagctatggacaagactcaaaacgatattgaaatcatcttgaaggacttgaaggtcgatgtcgttttctacgatttcacccactggttaccatctttggccagaaagatcggtatcaaatccgtcttttactccaccatttctccattgatgcacggttacgctttgtccccagaaagaagagttgtcggtaagcaattgactgaagctgacatgatgaaggctccagcttctttcccagacccatccatcaaattgcacgctcacgaagccagaggtttcaccgccagaaccgttatgaagttcggtggtgatatcactttcttcgatcgtattttcactgctgtttctgaatctgatggtttggcttactccacttgtcgtgaaatcgaaggtcaattctgtgactacattgaaactcaattccaaaagccagtcttattggctggtccagctttgccagttccttccaagtccaccatggaacaaaaatggtctgactggttaggtaagttcaaggaaggttctgtcatttactgtgctttcggttctgaatgtaccttgagaaaggacaaattccaagaactattatggggtttggaattgactggtatgccattctttgctgctttgaagcctccatttgaaactgaatctgttgaagctgccatcccagaagaattgaaggaaaagatccaaggtagaggtatcgttcacggtgaatgggttcaacaacaattgtttttgcaacacccatctgttggttgtttcgtttcccactgtggttgggcttctttgtccgaagctttggtcaatgactgtcaaatcgtcttgttgccacaagtcggtgaccaaattattaacgccagaatcatgtccgtttctttgaaggttggtgttgaagtcgaaaagggtgaagaagatggtgttttctccagagaatctgtctgtaaggccgtcaaggctgtcatggatgaaaagtctgaaatcggtagagaagttagaggtaaccacgacaaattgagaggtttcttgatgaacgctgacttggactccaagtacatggactctttcaaccaaaagttgcaagacttattaggg

SEQ ID NO: 102 - protein, 459 aa, Ipomoea purpurea
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 103 - DNA, 1314 bp, Bellis perennis
  CDS (1)..(1314)
atggactctaagattgactccaagactttcagagttgttatgttgccatggttggcttactcccacatctcttctttcttggttttcgctaagagattgaccaaccacaacttccacatctacatctgttcctctcaaaccaacatgcaatacttgaagaacaacttgacttctcaatactccaagtccatccaattgattgaattgaacttgccatcttcttctgaattgccattgcaataccacaccacccacggtctaccacctcatttgaccaagactctatccgatgactaccaaaaatctggtccagacttcgaaaccatcttgatcaaattgaaccctcacttagtcatctacgacttcaaccaattatgggctccagaagttgcttccactttgcacattccatctatccaattgttgtccggttgtgttgctttgtacgctttggatgctcatttgtacaccaagccattggatgaaaacttggccaagttcccattcccagaaatctacccaaagaacagagatatcccaaagggtggttccaaatacatcgaaagatttgtcgactgtatgagaagatcttgtgaaatcatcttggtcagatccactatggaattggaaggtaagtacattgactacttgtctaagactttaggtaagaaggtcttaccagttggtccattagtccaagaagcttctttgttgcaagatgaccacatctggatcatgaaatggttggacaagaaggaagaatcctctgttgtctttgtttgtttcggttctgaatacattttgtctgacaacgaaatcgaagacattgcttacggtttggaattgtctcaagtctctttcgtctgggctatcagagccaagacctctgctttgaatggtttcattgaccgtgttggtgacaagggtttggtcattgacaaatgggttccacaagctaacatcttgtcccactcttccactggtggtttcatctcccactgtggttggtcctctaccatggaatccatcagatacggtgttccaatcattgctatgccaatgcaattcgatcaaccatacaacgccagattgatggaaactgtcggtgctggtattgaagttggtagagatggtgaaggtagattgaagcgtgaagaaattgccgctgttgtcagaaaggttgttgttgaagattctggtgaatctatcagagaaaaggccaaggaattaggtgaaattatgaagaagaacatggaagctgaagtcgatggtattgtcattgaaaacttagtcaaattgtgtgaaatgaacaac

SEQ ID NO: 104 - protein, 438 aa, Bellis perennis
MDSKIDSKTFRVVMLPWLAYSHISSFLVFAKRLTNHNFHIYICSSQTNMQYLKNNLTSQYSKSIQLIELNLPSSSELPLQYHTTHGLPPHLTKTLSDDYQKSGPDFETILIKLNPHLVIYDFNQLWAPEVASTLHIPSIQLLSGCVALYALDAHLYTKPLDENLAKFPFPEIYPKNRDIPKGGSKYIERFVDCMRRSCEIILVRSTMELEGKYIDYLSKTLGKKVLPVGPLVQEASLLQDDHIWIMKWLDKKEESSVVFVCFGSEYILSDNEIEDIAYGLELSQVSFVWAIRAKTSALNGFIDRVGDKGLVIDKWVPQANILSHSSTGGFISHCGWSSTMESIRYGVPIIAMPMQFDQPYNARLMETVGAGIEVGRDGEGRLKREEIAAVVRKVVVEDSGESIREKAKELGEIMKKNMEAEVDGIVIENLVKLCEMNN

SEQ ID NO: 105 - DNA, 1419 bp, Stevia rebaudiana
  CDS (1)..(1419)
atggccacttctgactctattgtcgatgacagaaagcaattgcacgttgccactttcccatggttggccttcggtcacattttgccatacttgcaattgtccaagttgattgctgaaaagggtcacaaggtttctttcttgtccactaccagaaacatccaaagattatcttctcacatctctccattaatcaacgttgtccaattgactttaccaagagttcaagaattgccagaagatgctgaagctaccaccgatgtccatccagaagatatcccatacttgaagaaggcttctgacggtttgcaacctgaagtcacccgtttcttggaacaacactctccagactggatcatctacgactacactcactactggttaccttccattgctgcttctttgggtatctcccgtgctcatttctccgtcaccactccatgggctattgcttacatgggtccatctgctgatgctatgatcaacggttctgatggtagaaccactgttgaagatttgaccactccaccaaaatggttcccattcccaactaaggtctgttggagaaagcacgatttggccagattggttccatacaaggctccaggtatctctgatggttacagaatgggtttggttttgaaaggttctgactgtttgttgtccaaatgttaccatgaattcggtactcaatggttaccattgttggaaactttgcaccaagttccagttgttccagtcggtctattaccaccagaagtcccaggtgacgaaaaggacgaaacctgggtttccatcaagaaatggttagatggtaagcaaaagggttccgttgtctacgttgctttgggttctgaagtcttggtttctcaaactgaagttgtcgaattggctttaggtttggaattgtccggtttgcctttcgtctgggcttacagaaagccaaagggtccagctaaatctgactccgtcgaattaccagacggtttcgttgaaagaacccgtgacagaggtttggtctggacttcctgggctccacaattgagaatcttgtcccacgaatctgtttgtggtttcttgacccactgtggttctggttccattgtcgaaggtttgatgtttggtcacccattgatcatgttgccaatcttcggtgaccaaccattgaacgccagattattggaagacaagcaagtcggtattgaaattccaagaaacgaagaagatggttgtttgaccaaggaatctgttgccagatctttgagatccgttgttgtcgaaaaggaaggtgaaatctacaaggctaacgctagagaattgtctaagatctacaacgacaccaaggttgaaaaggaatacgtttctcaatttgtcgactacttggaaaagaacaccagagctgttgccattgaccacgaaagt

SEQ ID NO: 106 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 107 - DNA, 1455 bp, Stevia rebaudiana
  CDS (1)..(1455)
atgtacaacgtcacctaccatcaaaactccaaggctatggctacttctgactctattgtcgatgacagaaagcaattgcacgttgccactttcccatggttagctttcggtcacatcttaccattcttgcaattgtccaaattgattgctgaaaagggtcacaaggtttctttcttgtctaccactagaaacattcaaagattgtcttcccacatctctccattgatcaacgttgttcaattgactctaccaagagtccaagaattaccagaagatgctgaagctaccaccgatgtccatccagaagatatccaatacttgaagaaggctgttgacggtttgcaaccagaagttaccagattcttggaacaacactctccagactggatcatctacgacttcacccactactggttaccttccattgctgcctccttgggtatctccagagcttacttctgtgttatcactccatggaccattgcttacttggctccatcttctgatgctatgatcaacgactctgacggtagaaccactgtcgaagatttgaccactccacctaaatggttcccattcccaactaaggtctgttggagaaagcatgacttggccagaatggaaccatacgaagctccaggtatctccgatggttacagaatgggtatggttttcaagggttctgactgtttgttgttcaagtgttaccacgaattcggtactcaatggttaccattgttggaaactttgcaccaagtcccagttgtcccagtcggtttgttgccaccagaaatcccaggtgacgaaaaggacgaaacctgggtttccatcaagaaatggttggatggtaagcaaaagggttccgttgtctacgttgccttgggttctgaagctttagtctctcaaactgaagttgttgaattggctttgggtttggaattgtctggtctaccatttgtctgggcttacagaaagccaaagggtccagccaaatctgactccgttgaattgccagatggtttcgtcgaacgtaccagagacagaggtttagtctggacttcctgggctcctcaattgagaatcttgtctcacgaatctgtctgtggtttcttgactcactgtggttctggttccattgtcgaaggtttgatgttcggtcacccattgattatgttgccaattttctgtgaccaaccattgaacgctagattattggaagacaaacaagtcggtattgaaatcccaagaaacgaagaagatggttgtttgaccaaggaatctgttgctcgttctttgagatctgttgttgtcgaaaacgaaggtgaaatctacaaggccaatgctcgtgctttgtccaagatctacaacgataccaaggttgaaaaggaatacgtttctcaatttgttgactacttggaaaagaacgccagagctgttgccattgaccacgaatcc

SEQ ID NO: 108 - protein, 485 aa, Stevia rebaudiana
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 109 - DNA, 1419 bp, Stevia rebaudiana
  CDS (1)..(1419)
atggccacttctgactccattgttgatgacagaaagcaattgcacgttgctactttcccatggttggcctttggtcacattttgcctttcttgcaattgtctaaattgattgctgaaaagggtcacaaggtttccttcttgtctaccaccagaaacatccaaagattatcttcccacatctctcctttgatcaacgttgttcaattgactctaccacgtgtccaagaattaccagaagacgctgaagctactaccgatgtccacccagaagatatccaatacttgaagaaggctgtcgatggtttgcaaccagaagtcaccagattcttggaacaacactctccagactggatcatctacgacttcactcactactggttgccatccattgctgcttctttgggtatctccagagcttacttctgtgtcatcactccatggaccattgcttacttggctccatcttctgatgctatgattaacgattctgatggtagaaccaccgtcgaagacttgaccactccaccaaaatggttcccattcccaaccaaggtctgttggagaaagcacgacttggccagaatggaaccatacgaagctccaggtatctccgatggttacagaatgggtatggttttcaagggttccgactgtctattattcaaatgttaccatgaatttggtactcaatggttaccattgttggaaactttgcaccaagtcccagttgttccagttggtttgttgcctccagaaatcccaggtgatgaaaaggacgaaacctgggtttccatcaagaaatggttggacggtaagcaaaagggttctgttgtctacgttgctttgggttctgaagctttggtttctcaaactgaagttgtcgaattggctttaggtttggaattgtccggtttgccattcgtctgggcttacagaaagccaaagggtccagctaagtctgactctgttgaattgccagatggtttcgttgaaagaaccagagacagaggtttggtctggacttcttgggctccacaattgagaattttgtcccacgaatctgtctgtggtttcttgactcactgtggttctggttccattgtcgaaggtttgatgttcggtcatccattgatcatgttgccattattcggtgaccaaccattgaacgctagattattggaagacaaacaagtcggtattgaaattccaagaaacgaagaagatggttgtttgaccaaggaatccgttgctcgttctttacgttctgtcgttgtcgaaaacgaaggtgaaatctacaaggccaatgccagagaattgtccaagatctacaacgacaccaaggttgaaaaggaatacgtttctcaatttgtcgactacttggaaaagaacgccagagctgttgccatcgaccacgaatcc

SEQ ID NO: 110 - protein, 473 aa, Stevia rebaudiana
MATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPLFGDQPLNARLLEDKQVGIEIPRNEEDGCLTKESVARSLRSVVVENEGEIYKANARELSKIYNDTKVEKEYVSQFVDYLEKNARAVAIDHES

SEQ ID NO: 111 - DNA, 1356 bp, Populus trichocarpa
  CDS (1)..(1356)
atggacgaacctcacgaattgcacattgctatgttcccatggttggcctttggtcacatcattccattcttggaattagccaagttgattgctcaaagaggtcacaagatctctttcatctccactccaagaaacatccaaagattaccaaccatcccaccaaacttgaccccaagaatcaacttagtctctttggctttgccacacgttgaaaacttgccaaacaacgctgaagccactgctgacttgccattcgacaagatcccatacttgaagattgcttacgacagattgcaagactctttgttccatttcttgcactcttcttctccagactggatcatcttcgattttgcctcctactggttaccagaaattgctaccaaattgggtatctccggtgttttgttctccatcttcggtgcttggactttatctttcgctggtccatcttactctgccattttgaacggtgatgacccaagaaccgaaccacaacatttcaccgttccaccaaaatgggtcactttcccatccaaggttgctttccgtatccacgaagctaagagattcttggttcaaatcgaagctaactcttctggtgtcactgacatcttcagatggggttccgttttggctggttgtgatgtcattgccgtcagatcttgtttggaattggaagctgacttcttgagattggtcgaagatttgcactgtaagccagttatcccagtcggtctattaccacctccagctcaatgttctgaaggtggttccagagaaggtggtgtcgacgaaaaatgggttaccatttctgaatggttggacaagcaaactcaaggttccgttgtctacattgctttcggttctgaattgaccatcaaccaaaatgaaatcactgaattggctttgggtttagaattgtctggtttgccattcttctgggctttcagaaacagagatgactccgttagattgccagatggtttcgatgaaagagtcaagggtcgtggtgttgtctggacttcctgggctcctcaattgagaatcatggctcacgaatccgttggtggtttcttgactcactgtggttactcctctgttatcgaagctttgtccttcggtttggctttaatcatgttgccatttgccattgaccaaggtttgattgcccgtgttttcgaaggtaagaaggtcggtattgaagtcccaagagatgaacaagatggttccttcaccagaaactctgttgctgaatctctaagattggtcattgttgacaaggaaggttctgcttacagagaaaacgctaagcaacaaatggttactttgtttggtttgacctacaccatgacg

SEQ ID NO: 112 - protein, 452 aa, Populus trichocarpa
MDEPHELHIAMFPWLAFGHIIPFLELAKLIAQRGHKISFISTPRNIQRLPTIPPNLTPRINLVSLALPHVENLPNNAEATADLPFDKIPYLKIAYDRLQDSLFHFLHSSSPDWIIFDFASYWLPEIATKLGISGVLFSIFGAWTLSFAGPSYSAILNGDDPRTEPQHFTVPPKWVTFPSKVAFRIHEAKRFLVQIEANSSGVTDIFRWGSVLAGCDVIAVRSCLELEADFLRLVEDLHCKPVIPVGLLPPPAQCSEGGSREGGVDEKWVTISEWLDKQTQGSVVYIAFGSELTINQNEITELALGLELSGLPFFWAFRNRDDSVRLPDGFDERVKGRGVVWTSWAPQLRIMAHESVGGFLTHCGYSSVIEALSFGLALIMLPFAIDQGLIARVFEGKKVGIEVPRDEQDGSFTRNSVAESLRLVIVDKEGSAYRENAKQQMVTLFGLTYTMT

SEQ ID NO: 113 - DNA, 1362 bp, Stevia rebaudiana
  CDS (1)..(1362)
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatcttacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 114 - protein, 454 aa, Stevia rebaudiana
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSYGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 115 - DNA, 1362 bp, Stevia rebaudiana
  CDS (1)..(1362)
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatctgacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 116 - protein, 454 aa, Stevia rebaudiana
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSDGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 117 - DNA, 1449 bp, Stevia rebaudiana
  CDS (1)..(1449)
atggaccaaatggccaagattgacgaaaagaagcctcacgttgttttcattccattcccagctcaatctcacatcaagtgtatgttgaaattggccagaattttgcaccaaaagggtttgtacatcactttcatcaacactgacaccaaccacgaaagattggttgcctccggtggtactcaatggttggaaaatgctccaggtttctggttcaagaccgtcccagatggtttcggttctgccaaggatgacggtgtcaagccaactgatgctttgagagaattgatggactacttgaagaccaacttcttcgatttgttcttggacttggtcttgaagttggaagttccagctacctgtatcatctgtgatggttgtatgacctttgctaacaccattagagctgctgaaaagttgaacattccagtcatcttattctggaccatggctgcttgtggtttcatggctttctaccaagctaaggtcttaaaggaaaaggaaattgttccagtcaaggacgaaacctacttgaccaatggttacttggacatggaaattgactggatcccaggtatgaagagaatcagattacgtgacttgcctgaattcatcttggccaccaagcaaaactactttgctttcgaattcttgtttgaaactgctcaattagctgacaaggtttctcacatgatcattcacactttcgaagaattggaagcttctttagtctctgaaatcaaatctattttcccaaacgtttacactatcggtccattacaattgttgttgaacaagatcactcaaaaggaaaccaacaacgattcttactctttatggaaggaagaaccagaatgtgtcgaatggttgaactccaaggaaccaaactccgttgtttacgtcaactttggttctttggctgtcatgtctttgcaagatttggtcgaattcggttggggtttggttaactccaaccattacttcttatggatcatcagagctaacttgattgacggtaagccagctgtcatgccacaagaattgaaggaagccatgaacgaaaaaggtttcgttggttcttggtgttcccaagaagaagttttgaaccatccagccgttggtggtttcttgactcactgtggctggggttccatcattgaatctctatccgctggtgttccaatgttgggttggccatccattggtgaccaaagagccaactgtcgtcaaatgtgtaaggaatgggaagttggtatggaaatcggtaagaacgttaagagagatgaagtcgaaaaattagtcagaatgttgatggaaggtttggaaggtgaaagaatgagaaagaaggctttggaatggaagaaatctgctactttggctacttgttgtaacggttcctcttctttggatgttgaaaaattggctaacgaaatcaagaaattgtccaggaac

SEQ ID NO: 118 - protein, 483 aa, Stevia rebaudiana
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 119 - DNA, 1404 bp, Stevia rebaudiana
  CDS (1)..(1404)
atgccaatctccgatatcaatgctggttcccacattttggttttcccatacccagctcaaggtcacatgttgactctattagatttgacccaccaattggccatcagaaacttgactatcactatcttagtcaccccaaagaacttgccaaccatttctccattgttggctgctcatccaaccactgtttctgctttgttgttgccattaccacctcacccagccatcccatctggtattgaaaacgtcaaggacttgccaaacgatgctttcaaggctatgatggttgctttaggtgacttgtacaacccattgagagactggttcagaaaccaacctaacccaccagttgccatcatttctgacttcttcttgggttggactcaccacttggctgtcgaattaggtatcagaagatacactttctctccatctggtgctttggctttgtccgtcattttctctttatggagataccaaccaaagagaatcgatgtcgaaaacgaaaaggaagctatcaaattcccaaagattccaaactctccagaatacccatggtggcaattatctccaatctacagatcttacgttgaaggtgacccagattctgaattcatcaaggatggtttcttggctgatattgcttcctggggtattgtcatcaactctttcaccgaattggaacaagtctacgttgaccatttgaagcatgaattgggtcacgaccaagtctttgctgtcggtccattattgcctccaggtgacaagacttctggtagaggtggttcttcttccaacgatgtcttgtcctggttggacacctgtgctgacagaaccgttgtctacgtttgtttcggttctcaaatggttttgaccaacggtcaaatggaagttgttgctttgggtttggaaaagtcccgtgtcaaatttgtctggtccgtcaaggaaccaactgttggtcacgaagctgctaactacggtcgtgttccaccaggtttcgaagacagagtttccggtcgtggtttggttatcagaggttgggttccacaagttgccattttgtctcacgactccgttggtgttttcttgacccactgtggttggaactctgtcatggaagctgttgctgctgaagttttgatgttgacctggccaatgtccgctgaccaattctccaatgccactttgttgcacgaattgaaggttggtatcaaggtttgtgaaggttccaacattgtcccaaactctgacgaattggctgaattgttctccaaatctctatccgatgaaactagattggaaagaaagagagtcaaggaatttgccaaatctgccaaggaagccgtcggtccaaagggttcctctgtcggtgaattagaaagattggttgacaacttgtctttg

SEQ ID NO: 120 - protein, 468 aa, Stevia rebaudiana
MPISDINAGSHILVFPYPAQGHMLTLLDLTHQLAIRNLTITILVTPKNLPTISPLLAAHPTTVSALLLPLPPHPAIPSGIENVKDLPNDAFKAMMVALGDLYNPLRDWFRNQPNPPVAIISDFFLGWTHHLAVELGIRRYTFSPSGALALSVIFSLWRYQPKRIDVENEKEAIKFPKIPNSPEYPWWQLSPIYRSYVEGDPDSEFIKDGFLADIASWGIVINSFTELEQVYVDHLKHELGHDQVFAVGPLLPPGDKTSGRGGSSSNDVLSWLDTCADRTVVYVCFGSQMVLTNGQMEVVALGLEKSRVKFVWSVKEPTVGHEAANYGRVPPGFEDRVSGRGLVIRGWVPQVAILSHDSVGVFLTHCGWNSVMEAVAAEVLMLTWPMSADQFSNATLLHELKVGIKVCEGSNIVPNSDELAELFSKSLSDETRLERKRVKEFAKSAKEAVGPKGSSVGELERLVDNLSL

SEQ ID NO: 121 - DNA, 1383 bp, Stevia rebaudiana
  CDS (1)..(1383)
atggaatcttccaaggtcattttgtacccatctccaggtattggtcacttggtttccatggtcgaattgggtaaattgattcacacccaccacccatctctatccgtcatcatcttggttttgccagctacctacgaaactggttccaccaccacctacatcaacactgtttctaccaccactccattcatcactttccaccacttgccagtcattccattgccaccagactcctcttctgaatttatcgatttggctttcgacattccacaattatacaacccagttgtctacaacactttggttgccatctctgaaacttccaccatcaaggctgttatcttggacttctttgtcaacgccgctttccaaatctccaagtctttggacttgccaacctactacttcttcacttctggtgcttctggtctatgtgctttcttgcatttgccaactatctacaagacctactccggtaacttcaaggacttggacactttcatcaacattccaggtgttcctcctatccactcttctgacatgccaaccgtcttattcgacaaggaatccaactcttacaagaactttgtcaagacttccaacaacatggccaaatcttctggtgtcattgctaactccttcttgcaattggaagaaagagctgctcaaactttgagagatggtaagtccatcaccgatggtccatctccaccaatctacttgattggtccattgatcgcttctggtaaccaagttgaccataatgaaaacgaatgtttgaaatggttaaacactcaaccatccaaatctgttgttttcttgtgtttcggttctcaaggtgttttcaagaaggaacaattgaaggaaattgctgttggtttggaaagatctggtcaaagattcttatgggttgtcagaaagcctccatctgatggtggtaaggaattcggtttggatgacgtcttgccagaaggtttcgttgccagaaccaaggaaaagggtttggttgtcaagaactgggctccacaaccagctattttgggtcacgaatctgtcggtggtttcgtttcccactgtggttggaactcttctttggaagccgttgttttcggtgtcccaatggttgcttggccattatacgctgaacaaaagatgaaccgtgtctacttggtcgaagaaatcaaggttgctttatggttaagaatgtccgctgatggttttgtctctgctgaagctgttgaagaaactgtcagacaattgatggacggtagaagagttcgtgaaagaattttggaaatgtccaccaaggccaaggccgctgtcgaagatggtggttcttccagagttgacttcttcaaattgactgaatcctggacccacaag

SEQ ID NO: 122 - protein, 461 aa, Stevia rebaudiana
MESSKVILYPSPGIGHLVSMVELGKLIHTHHPSLSVIILVLPATYETGSTTTYINTVSTTTPFITFHHLPVIPLPPDSSSEFIDLAFDIPQLYNPVVYNTLVAISETSTIKAVILDFFVNAAFQISKSLDLPTYYFFTSGASGLCAFLHLPTIYKTYSGNFKDLDTFINIPGVPPIHSSDMPTVLFDKESNSYKNFVKTSNNMAKSSGVIANSFLQLEERAAQTLRDGKSITDGPSPPIYLIGPLIASGNQVDHNENECLKWLNTQPSKSVVFLCFGSQGVFKKEQLKEIAVGLERSGQRFLWVVRKPPSDGGKEFGLDDVLPEGFVARTKEKGLVVKNWAPQPAILGHESVGGFVSHCGWNSSLEAVVFGVPMVAWPLYAEQKMNRVYLVEEIKVALWLRMSADGFVSAEAVEETVRQLMDGRRVRERILEMSTKAKAAVEDGGSSRVDFFKLTESWTHK

SEQ ID NO: 123 - DNA, 1455 bp, Stevia rebaudiana
  CDS (1)..(1455)
atgtacaacgttacttaccatcaaaactccaaggccatggctacctctgactccattgtcgacgacagaaagcaattgcacgttgccactttcccatggttggctttcggtcacatcttgccattcttgcaattgtccaaattgattgctgaaaagggtcacaaagtctctttcttgtctaccaccagaaacatccaaagattgtcctctcacatctctccattgattaacgttgtccaattgactttaccaagagtccaagaattgccagaagatgctgaagctactactgatgttcacccagaagatatccaatacttgaagaaggctgtcgatggtttgcaaccagaagttaccagattcttggaacaacactctccagactggatcatctacgacttcactcactactggttaccatccattgctgcttctttgggtatctccagagcttacttctgtgttatcactccatggaccattgcttacttggctccatcttctgatgccatgatcaacgactctgatggtagaaccactgttgaagatttgaccaccccacctaaatggttcccattcccaaccaaggtctgttggagaaagcatgatttggccagaatggaaccatacgaagctccaggtatctctgacggttacagaatgggtatggttttcaagggttctgactgtttgttgttcaaatgttaccatgaattcggtactcaatggttacctctattagaaactttgcaccaagttccagttgttccagtcggtttgttgcctccagaaatcccaggtgacgaaaaggacgaaacctgggtttccatcaagaaatggttggatggtaagcaaaagggttccgttgtctacgttgctttaggttctgaagctttagtctctcaaactgaagttgtcgaattggctttgggtttggaattgtccggtttgccatttgtctgggcttacagaaagccaaagggtccagccaagtctgattctgtcgaattaccagatggtttcgtcgaaagaacccgtgaccgtggtttggtctggacttcctgggctccacaattgagaattttgtcccacgaatctgtctgtggtttcttgactcactgtggttctggttccattgttgaaggtttgatgttcggtcacccattgatcatgttgccaatcttctgtgaccaaccattaaacgctagattgttggaagacaagcaagtcggtattgaaattccaagaaacgaagaagacggttgtttgaccaaggaatccgttgccagatctttgagatctgttgttgtcgaaaacgaaggtgaaatctacaaggctaacgctcgtgctctatccaagatctacaacgacaccaaggtcgaaaaggaatacgtttctcaatttgttgactacttggaaaagaacgccagagctgttgccattgaccacgaaagt

SEQ ID NO: 124 - protein, 485 aa, Stevia rebaudiana; identical to SEQ ID NO: 108

SEQ ID NO: 125 - DNA, 1485 bp, Stevia rebaudiana
  CDS (1)..(1485)
atgtctccaaagatggttgctccaccaaccaacttgcacttcgtcttattcccattgatggctcaaggtcacttggttccaatggtcgacattgctagaattttggctcaaagaggtgctaccgtcaccatcatcaccactccataccatgccaacagagtcagaccagttatctccagagccattgctaccaacttgaaaatccaattgttggaattgcaattgagatccactgaagctggtttgccagaaggttgtgaatctttcgaccaattgccatctttcgaatactggaagaacatctccactgccattgacttgttgcaacaaccagctgaagatctattgagagaattgtctccacctccagactgtatcatctccgatttcttgttcccatggaccactgatgtcgccagaagattgaacattccaagattggttttcaacggtccaggttgtttctacttgttgtgtatccacgttgccatcacttctaacatcttaggtgaaaacgaacctgtttcctccaacactgaaagagttgttttgccaggtttaccagatcgtattgaagttaccaaattgcaaatcgtcggttcttccagaccagctaacgttgacgaaatgggttcctggttaagagctgtcgaagctgaaaaggcttctttcggtattgtcgtcaacacctttgaagaattggaaccagaatacgtcgaagaatacaagaccgtcaaggacaagaagatgtggtgtatcggtccagtttctctatgtaacaagactggtccagacttggctgaaagaggtaacaaggctgccatcaccgaacacaactgtttgaaatggttggatgaaagaaagttgggttctgtcttgtacgtttgtttgggttctttggccagaatctccgctgctcaagccattgaattaggtttaggtttggaatctatcaacagaccatttatctggtgtgttagaaacgaaactgatgaattgaagacttggttcttggacggtttcgaagaaagagttcgtgacagaggtttgattgttcacggttgggctccacaagttttgatcttatctcacccaaccattggtggtttcttgactcactgtggttggaactctaccattgaatccatcactgctggtgttccaatgatcacctggccattctttgctgaccaattcttgaatgaagctttcatcgttgaagttttgaaaattggtgtcagaatcggtgttgaaagagcttgtttgttcggtgaagaagacaaggtcggtgtcttagtcaagaaggaagatgttaagaaggctgttgaatgtttgatggacgaagatgaagacggtgaccaaagaagaaagcgtgtcattgaattggccaagatggctaagattgctatggctgaaggtggttcttcttacgaaaacgtttcctctttgatcagagatgtcactgaaactgtccgtgctcctcat

SEQ ID NO: 126 - protein, 495 aa, Stevia rebaudiana
MSPKMVAPPTNLHFVLFPLMAQGHLVPMVDIARILAQRGATVTIITTPYHANRVRPVISRAIATNLKIQLLELQLRSTEAGLPEGCESFDQLPSFEYWKNISTAIDLLQQPAEDLLRELSPPPDCIISDFLFPWTTDVARRLNIPRLVFNGPGCFYLLCIHVAITSNILGENEPVSSNTERVVLPGLPDRIEVTKLQIVGSSRPANVDEMGSWLRAVEAEKASFGIVVNTFEELEPEYVEEYKTVKDKKMWCIGPVSLCNKTGPDLAERGNKAAITEHNCLKWLDERKLGSVLYVCLGSLARISAAQAIELGLGLESINRPFIWCVRNETDELKTWFLDGFEERVRDRGLIVHGWAPQVLILSHPTIGGFLTHCGWNSTIESITAGVPMITWPFFADQFLNEAFIVEVLKIGVRIGVERACLFGEEDKVGVLVKKEDVKKAVECLMDEDEDGDQRRKRVIELAKMAKIAMAEGGSSYENVSSLIRDVTETVRAPH

SEQ ID NO: 127 - DNA, 1272 bp, Stevia rebaudiana
  CDS (1)..(1272)
atgttgcaattggctacctacttgcactctcaaggtatctccatcactattgctcaatacccaaacttcaactctccagactcctccaaccacccagaattgactttcttaccattatcttccggtaacttgtccgttgctgatatctctggtggtttcttcaaattcattcaaaccttgaaccacaactgtaagcctcacttcagagaatacttggttcaaaacatgtcctctgatgacaaggaatccattgtcatcatcagagacaacttgatgttctttgctggtgaaatcgctggtgaattaggtttaccatctatcatcttgagaggttctaacgctgtcatgttgactgcttccgatatcattccacaattgcaccaagaaggtagattcccaccaccagactctctattgcaagaaaccattccagaattggttccattcagatacaaggacttgccattcatcggttacccaattcaccaaaccttggaattctccattaccatgatgaccccaaagtctccagcttctgccatcttgatcaacactttagaattcttggaacaatctgctttgactcaaatccgtgaccactacaaggtcccagttttcactatcggtccattgcacaagattgtcactaccagatccacttccatcttggaagaagacacctcttgtatcaactggttggacaagcaatctccaaagtctgttgtctacgtttctctaggttctttggccaaattggacgaaaaggttgcttctgaaatggcttgtggtttggccatgtccaaccataaattcttatgggttgtcagaccaggtatggtccatggtttcgaatgggttgaatttttgccagactctttggttggtgaaatgaaggccagaggtttgattgtcaaatgggctccacaaaccactgttttggctcacaacgctgtcggtggtttttggtcccactgtggttggaactctactatcgaatgtttggctgaaggtgttccaatgatgtgtcaacctttcttcgctgaccaattgttgaatgctcgttacgtttccgatgtctggaagaccggtttcgaaattgtcattgaaaagggtgaaattgcttgtgccatcaagagagttttggtcgatgaagaaggtgaagaaatgagacaaagagctatggaaatcaaggaaaaggtcaagattgccatcaacgatggtggttcttcttacgactctttcaaggatttggttgctttcatctcctctttg

SEQ ID NO: 128 - protein, 424 aa, Stevia rebaudiana
MLQLATYLHSQGISITIAQYPNFNSPDSSNHPELTFLPLSSGNLSVADISGGFFKFIQTLNHNCKPHFREYLVQNMSSDDKESIVIIRDNLMFFAGEIAGELGLPSIILRGSNAVMLTASDIIPQLHQEGRFPPPDSLLQETIPELVPFRYKDLPFIGYPIHQTLEFSITMMTPKSPASAILINTLEFLEQSALTQIRDHYKVPVFTIGPLHKIVTTRSTSILEEDTSCINWLDKQSPKSVVYVSLGSLAKLDEKVASEMACGLAMSNHKFLWVVRPGMVHGFEWVEFLPDSLVGEMKARGLIVKWAPQTTVLAHNAVGGFWSHCGWNSTIECLAEGVPMMCQPFFADQLLNARYVSDVWKTGFEIVIEKGEIACAIKRVLVDEEGEEMRQRAMEIKEKVKIAINDGGSSYDSFKDLVAFISSL

SEQ ID NO: 129 - DNA, 1422 bp, Stevia rebaudiana
  CDS (1)..(1422)
atgtctacctctgaattggttttcattccatctccaggtgctggtcatttgccaccaactgttgaattggccaaattgttgttgcaccgtgaccaaagattgtctgtcaccatcattgtcatgaacttatggttaggtccaaagcacaacactgaagccagaccatgtgttccttccttgagattcgtcgatatcccatgtgacgaatctaccatggctttgatctctccaaacactttcatctctgcctttgtcgaacaccacaagccaagagttcgtgacatcgttcgtggtatcattgaatctgactctgtcagattggctggtttcgtcttggacatgttctgtatgccaatgtccgatgttgctaacgaatttggtgttccatcttacaactacttcacctctggtgctgccactttaggtttgatgttccatttgcaatggaagagagatcacgaaggttacgacgctactgaattgaagaactctgacactgaattatctgtcccatcttacgttaaccctgttccagccaaggtcttgccagaagttgttttggacaaggaaggtggttccaagatgttcttggatttggctgaaagaatcagagaatccaagggtatcatcgttaactcttgtcaagctattgaaagacacgctttggaatacctatcctccaacaacaacggtattccacctgttttcccagtcggtccaatcttgaacttggaaaacaagaaggacgatgctaagactgacgaaatcatgagatggttgaacgaacaaccagaatcctctgttgttttcttgtgtttcggttccatgggttctttcaacgaaaagcaagtcaaagaaattgctgttgccattgaaagatctggtcacagatttttatggtctttgagaagaccaactccaaaggaaaagattgaattcccaaaggaatacgaaaacttggaagaagtcttaccagaaggtttcttgaagagaacctcttctatcggtaaggttatcggttgggctccacaaatggctgtcttgtcccacccatccgtcggtggtttcgtttcccactgtggttggaactccactttggaatccatgtggtgtggtgtcccaatggctgcttggccattatacgctgaacaaactttgaatgctttcttgttggttgtcgaattgggtttggctgctgaaattagaatggactacagaaccgataccaaggctggttacgatggtggtatggaagtcaccgttgaagaaattgaagacggtatcagaaagttgatgtctgacggtgaaatcagaaacaaggtcaaggatgtcaaggaaaaatccagagctgccgttgttgagggtggttcttcttacgcttccattggtaaattcatcgaacacgtttccaacgtcaccata

SEQ ID NO: 130 - protein, 474 aa, Stevia rebaudiana
MSTSELVFIPSPGAGHLPPTVELAKLLLHRDQRLSVTIIVMNLWLGPKHNTEARPCVPSLRFVDIPCDESTMALISPNTFISAFVEHHKPRVRDIVRGIIESDSVRLAGFVLDMFCMPMSDVANEFGVPSYNYFTSGAATLGLMFHLQWKRDHEGYDATELKNSDTELSVPSYVNPVPAKVLPEVVLDKEGGSKMFLDLAERIRESKGIIVNSCQAIERHALEYLSSNNNGIPPVFPVGPILNLENKKDDAKTDEIMRWLNEQPESSVVFLCFGSMGSFNEKQVKEIAVAIERSGHRFLWSLRRPTPKEKIEFPKEYENLEEVLPEGFLKRTSSIGKVIGWAPQMAVLSHPSVGGFVSHCGWNSTLESMWCGVPMAAWPLYAEQTLNAFLLVVELGLAAEIRMDYRTDTKAGYDGGMEVTVEEIEDGIRKLMSDGEIRNKVKDVKEKSRAAVVEGGSSYASIGKFIEHVSNVTI

SEQ ID NO: 131 - DNA, 1437 bp, Stevia rebaudiana
  CDS (1)..(1437)
atggcctccattgctgaaatgcaaaagcctcatgccatctgtatcccatacccagctcaaggtcacatcaacccaatgatgcaatttgccaaattgttgcacttcaagggtttccacatctctttcgttaacaaccattacaaccacaagagattacaaagatctagaggtctatccgctttggaaggtttgccagacttccacttctactccatcccagatggtttgcctccatctaacgctgaagctactcaatccattccaggtctatgtgaatctattccaaagcactctttggaaccattctgtgacttgattgccactttgaatggttctgatgttccaccagtctcctgtatcatctctgacggtgtcatgtctttcactttgcaagctgctgaaagattcggtttaccagaagtcttattctggactccatctgcttgtggtttcttggcttacactcactacagagatttggttgacaaagaatacattccattgaaggacaccaatgatttgaccaacggttacttggaaacttctttggactggatcccaggtatgaagaacatcagattaaaggacttcccatctttcatcagaaccaccgatatcaacgatatcatgttgaactacttcttgattgaaactgaagccattccaaagggtgttgccatcatcttgaacactttcgatgctttggaaaaggactctatcactccagtcttggctttgaaccctcaaatctacaccatcggtccattgcacatgatgcaacaatacgtcgaccatgatgaaagattgaagcacattggttccaacttatggaaggaagacgtttcttgtatcaactggttggacaccaagaagccaaactccgttgtctacgtcaactttggttccatcactgttatgaccaaggaacaattgattgaattcggttggggtttggctaactctaagaaggacttcttatggatcaccagaccagacattgttggtggtaacgaagctatgattccagctgaattcattgaagaaaccaaggaaagaggtatggttacttcctggtgttcccaagaagaagttttgaagcacccatccattggtgttttcttgacccactctggttggaactccaccattgaatccatctctaacggtgttccaatgatctgttggccattcttcgctgaacaacaaaccaactgtcgttactgttgtgtcgaatgggaaatcggtttggaaattgacactgacgtcaagcgtgaagaagttgaagctcaagttagagaaatgatggatggttctaagggtaagatgatgaaaaacaaggctttggaatggaagaagaaggctgaagaagctgtctctattggtggttcttcttacttgaactttgaaaaattggtcaccgatgtcttgttgcgcaaa

SEQ ID NO: 132 - protein, 479 aa, Stevia rebaudiana
MASIAEMQKPHAICIPYPAQGHINPMMQFAKLLHFKGFHISFVNNHYNHKRLQRSRGLSALEGLPDFHFYSIPDGLPPSNAEATQSIPGLCESIPKHSLEPFCDLIATLNGSDVPPVSCIISDGVMSFTLQAAERFGLPEVLFWTPSACGFLAYTHYRDLVDKEYIPLKDTNDLTNGYLETSLDWIPGMKNIRLKDFPSFIRTTDINDIMLNYFLIETEAIPKGVAIILNTFDALEKDSITPVLALNPQIYTIGPLHMMQQYVDHDERLKHIGSNLWKEDVSCINWLDTKKPNSVVYVNFGSITVMTKEQLIEFGWGLANSKKDFLWITRPDIVGGNEAMIPAEFIEETKERGMVTSWCSQEEVLKHPSIGVFLTHSGWNSTIESISNGVPMICWPFFAEQQTNCRYCCVEWEIGLEIDTDVKREEVEAQVREMMDGSKGKMMKNKALEWKKKAEEAVSIGGSSYLNFEKLVTDVLLRK

SEQ ID NO: 133 - DNA, 1374 bp, Stevia rebaudiana
  CDS (1)..(1374)
atggaaaacaagactgaaactaccgttcgtcgtagaagaagaatcatcttattcccagttccagttcaaggtcacatcaacccaattttgcaattggctaacgtcttatactccaagggtttctccatcactattttccacactaacttcaacaagccaaagacctccaactacccacacttcaccttcagatttattttggacaatgaccctcaagatgtcagaatctccaacttgccaactcacggtccattgaccgtcatgagaattttgatcatcaacgaacacggtgctgatgaattgcaaagagaattggaattgttgatgttggcctccgaagaagacggtgaagtctcctgtttgattaccgaccaaatctggtacttcacccaatctgttgctgactctttgaacttgagaagattggttttgatgacttcttctttgttcaacttccacgctcatgtttctttgcctcaattcgatgaattgggttacttggacccagacgacaagactagattagaagaacaagcttctggtttcccaatgttgaaggtcaaggatatcaaatgtggtttctctatgtggaagcaaggtaaggaaatctttgaaaacatcaccaagcaaaccaaggcttcttctggtgtcatctggaactctttcaaggaattggaagaatctgaattggaaaccgtcatcagagaaatcccagctccatccttcttgattccattgccaaagcatttgactgcttcctcttcttctctattagaccacgacagaactgttttcccatggttagaccaacaaccatctcgttctgtcttgtacgtttctttcggttctgctactgaagtcgatgctaaggacttcttggaaattgctcgtggtttggtcgactccaagcaatctttcttatgggttgttagaccaggtttcgtcaagggttccacctgggttgaaccattgccagatggtttcttgggtgaaagaggtagaattgtcaaatgggttccacaacaagaagttttggctcacggtgccattggtgctttctggacccactctggttggaactccactttggaatccgtttgtgaaggtgttccaatgattttctctgcctttgcctttgaccaaccattaaacgctagatacatgtccgatgtcttgaaggttggtgtctacttggaaaacggttgggaaagaggtgaaattgccaacgccatcagaagagttatggtcgatgaagaaggtggttacatcagacaaaacgcttccgtcttgaagcaaaaggctgatgtttccttgatgaagggtggttcttcttacgaatctctagaatctttggttgcttacatctccagctta

SEQ ID NO: 134 - protein, 458 aa, Stevia rebaudiana
MENKTETTVRRRRRIILFPVPVQGHINPILQLANVLYSKGFSITIFHTNFNKPKTSNYPHFTFRFILDNDPQDVRISNLPTHGPLTVMRILIINEHGADELQRELELLMLASEEDGEVSCLITDQIWYFTQSVADSLNLRRLVLMTSSLFNFHAHVSLPQFDELGYLDPDDKTRLEEQASGFPMLKVKDIKCGFSMWKQGKEIFENITKQTKASSGVIWNSFKELEESELETVIREIPAPSFLIPLPKHLTASSSSLLDHDRTVFPWLDQQPSRSVLYVSFGSATEVDAKDFLEIARGLVDSKQSFLWVVRPGFVKGSTWVEPLPDGFLGERGRIVKWVPQQEVLAHGAIGAFWTHSGWNSTLESVCEGVPMIFSAFAFDQPLNARYMSDVLKVGVYLENGWERGEIANAIRRVMVDEEGGYIRQNASVLKQKADVSLMKGGSSYESLESLVAYISSL

SEQ ID NO: 135 - DNA, 1377 bp, Stevia rebaudiana
  CDS (1)..(1377)
atggaaaacaagactgaaactactgtcagaagaagacgtcgtatcatcttgttcccagttccattccaaggtcacatcaacccaatgttacaattagctaacgtcttgtactccaagggtttctccatcaccattttccacaccaacttcaacaagccaaagacttctaactacccacacttcactttcagatttatcttggacaacgaccctcaagatgtcagaatttccaacttgccaacccacggtccattggctgtcatgagaattttgatcatcaacgaacacggtgccgacgaattgagaagagaattggaattgttgatgttggcttctgaagaagatggtgaagtttcctgtttgattgctgaccaaatctggtacttcacccaatctgttgctgactctttgaacttgagaagattggtcttggtcacttcttctttgttcaacttccacgctcatgtctctttgccacaatttgacgaattgggttacttggacccagatgacaagaccagattggaagaacaagcttctggtttcccaatgttgaaggttaaggatatcaaatgttctttctccatgtggaagaaatacaaggaatactttgaaaacatcaccaagcaaaccaaggcctcctccggtgttatctggaactctttcaaggaattagaagaatctgaattggaaactgttatcagagaaattccagctccatctttcttaatcccattaccaaagcatttgactgcttcttcttcctctttgttggaccacgacagaaccgttttcccatggttggaccaacaaccatccagatctgtcttgtacgtttctttcggttctggtactgaagtcttagatgaaaaggacttcttggaaattgccagaggtttagtcgactccaagcaatctttcttgtgggttgttagaccaggtttcgtcaagggttccacctgggttgaaccattgccagatggtttcttgggtgaaagaggtagaattgtcaaatgggttcctcaacaagaagttttggctcacggtgccattggtgctttctggacccactctggttggaactccactttggaatctgtttgtgaaggtgttccaatgattttctccgatttcggtctagaccaaccattgaacgctcgttacatgtccgatgttttgaaggttggtgtctacttggaaaacggttgggaaagaggtgaaattgctaacgccatcagaagagtcatggttgacgaagaaggtgaatacatcagacaaaatgctcgtgtcttgaaacaaaaggctgatgtttctttgatgaagggtggttcttcttacgaatccttggaatctttagtctcttacatctcctcctta

SEQ ID NO: 136 - protein, 459 aa, Stevia rebaudiana
MENKTETTVRRRRRIILFPVPFQGHINPMLQLANVLYSKGFSITIFHTNFNKPKTSNYPHFTFRFILDNDPQDVRISNLPTHGPLAVMRILIINEHGADELRRELELLMLASEEDGEVSCLIADQIWYFTQSVADSLNLRRLVLVTSSLFNFHAHVSLPQFDELGYLDPDDKTRLEEQASGFPMLKVKDIKCSFSMWKKYKEYFENITKQTKASSGVIWNSFKELEESELETVIREIPAPSFLIPLPKHLTASSSSLLDHDRTVFPWLDQQPSRSVLYVSFGSGTEVLDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 137 - DNA, 1419 bp, Stevia rebaudiana
  CDS (1)..(1419)
atggctacttctgactccattgtcgatgacagaaagcaattgcacgttgccactttcccatggttggctttcggtcacattttgccattcttgcaattgtccaaattgattgctgaaaagggtcacaaggtttctttcttgtccactaccagaaacatccaaagattatcttctcacatctctccattgatcaacgttgtccaattgactttgccaagagtccaagaattgccagaagatgctgaagctaccaccgatgtccacccagaagatatccaatacttgaagaaggctgtcgatggtttgcaaccagaagtcaccagattcttggaacaacactctccagactggatcatctacgacttcacccactactggttaccatccattgctgcttctttgggtatctccagagcttacttctgtgtcatcactccatggaccattgcttacttggctccatcttctgatgccatgatcaacgactctgacggtagaaccactgttgaagatttgaccactccacctaaatggttcccattcccaaccaaggtttgttggagaaagcatgacttggccagaatggaaccttacgaagctccaggtatttctgatggttacagaatgggtatggttttcaagggttctgactgtctattattcaaatgttaccatgaattcggtactcaatggttgccattgttggaaactttgcaccaagttccagttgttccagtcggtttgttgccaccagaaattccaggtgatgaaaaggatgaaacctgggtttccatcaagaaatggttggacggtaagcaaaagggttccgttgtctacgttgctttgggttctgaagctttggtttctcaaactgaagttgtcgaattggctttgggtctagaattgtccggtttaccatttgtctgggcttacagaaagccaaagggtccagccaaatctgattccgtcgaattaccagacggtttcgtcgaaagaacccgtgaccgtggtttagtctggacttcctgggctccacaattgagaatcttgtcccacgaatccgtttgtggtttcttgactcactgtggttctggttctattgtcgaaggtttgatgttcggtcacccattgattatgttgcctttgtttggtgaccaaccattaaacgctagattattggaagacaagcaagtcggtatcgaaattccaagaaacgaagaagacggttgtttgaccaaggaatccgttgctcgttctttgagatccgttgttgtcgaaaacgaaggtgaaatctacaaggccaacgccagagaattgtctaagatctacaacgacaccaaggttgaaaaggaatacgtttctcaatttgtcgactacttggaaaagaacgctagagctgttgccatcgaccacgaaagc

SEQ ID NO: 138 - protein, 473 aa, Stevia rebaudiana; identical to SEQ ID NO: 110

SEQ ID NO: 139 - DNA, 1419 bp, Stevia rebaudiana
  CDS (1)..(1419)
atggctacctctgactccattgtcgatgaccgtaaacaattgcacgttgctactttcccatggttggctttcggtcacatcttgccttacttgcaattgtccaagttgattgctgaaaagggtcacaaggtttctttcttgtccactactagaaacatccaaagattatcttctcacatctctccattgatcaacgttgtccaattgactttgccaagagttcaagaattaccagaagatgctgaagctaccaccgatgtccacccagaagacattccatacttgaagaaggcctctgacggtttgcaaccagaagtcactagattcttggaacaacactctccagactggatcatctacgactacactcactactggttgccatccattgctgcttctttgggtatctccagagcccatttctccgtcaccactccatgggctattgcttacatgggtccatctgctgatgctatgatcaacggttctgacggtagaaccaccgtcgaagatttgactaccccacctaaatggttcccattcccaaccaaggtttgttggagaaagcatgatttggccagattagtcccatacaaggctccaggtatttctgatggttacagaatgggtttggtcttgaaaggttctgactgtttgttgtccaaatgttaccacgaattcggtactcaatggttaccattgttggaaactttgcaccaagttccagttgttccagtcggtttgttgcctccagaagttccaggtgacgaaaaggatgaaacctgggtttccatcaagaaatggttggatggtaagcaaaagggttccgttgtctacgttgctttgggttctgaagtcttggtcagccaaactgaagttgtcgaattggctttaggtttggaattgtccggtctaccatttgtctgggcttacagaaagccaaagggtccagctaagtctgactccgttgaattgccagatggtttcgtcgaaagaaccagagacagaggtttggtttggacttcttgggctccacaattgagaatcttatctcacgaatctgtttgtggtttcttgacccactgtggttctggttccatcgtcgaaggtttgatgttcggtcacccattaatcatgttgccaattttcggtgaccaaccattgaacgccagattattggaagacaagcaagtcggtattgaaattccaagaaacgaagaagatggttgtttgaccaaggaatccgttgccagatctctacgttctgttgttgtcgaaaaggaaggtgaaatctacaaggccaacgctcgtgaattatccaagatctacaacgacaccaaggttgaaaaggaatacgtttctcaatttgttgactacttggaaaagaacactagagctgttgccattgaccatgagtct

SEQ ID NO: 140 - protein, 473 aa, Stevia rebaudiana; identical to SEQ ID NO: 106

SEQ ID NO: 141 - DNA, 2361 bp, Stevia rebaudiana
atgaaaaccggtttcatctctcccgccactgttttccaccaccgaatctcccccgccaccaccttccgacaccacctctcccctgccaccaccaactccactggtattgttgctctgcgagacatcaacttccgatgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 142 - DNA, 2229 bp, Stevia rebaudiana
atgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 143 - DNA, 2352 bp, Stevia rebaudiana
atgaacctgtctctctgtatcgcctctcctctcctcaccaagtccaaccgacccgctgctctgtctgccatccacaccgcctccacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 144 - DNA, 2271 bp, Stevia rebaudiana
atgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 145 - DNA, 1539 bp, Stevia rebaudiana
atggacgccgtcactggtctgctcaccgtccccgccactgccatcaccatcggtggtactgccgttgctctggccgttgctctcatcttctggtacctcaagtcctacacctctgcccgacgatcccagtccaaccacctcccccgagtccccgaggtccccggtgtccccctgctcggtaacctgctccagctcaaggagaagaagccctacatgaccttcacccgatgggctgccacctacggccccatctactccatcaagactggtgccacctccatggttgttgtctcttccaacgagattgctaaagaggctctcgtcacccgattccagtccatctccacccgaaacctctccaaggctctcaaggttctgaccgccgacaagaccatggttgccatgtccgactacgacgactaccacaagaccgtcaagcgacacattctcaccgccgttctcggccccaacgcccagaagaagcaccgaatccaccgagacatcatgatggacaacatctccacccagctccacgagtttgtcaagaacaaccccgagcaggaagaggttgatctccgaaagatcttccagtccgagctcttcggtctggccatgcgacaggctctgggcaaggatgtcgagtctctctacgtcgaggatctcaagatcaccatgaaccgagatgagatcttccaggttctggttgtcgaccccatgatgggtgccattgatgtcgactggcgagacttcttcccctacctcaagtgggtccccaacaagaagtttgagaacaccatccagcagatgtacatccgacgagaggctgtcatgaagtctctcatcaaggagaacaagaagcgaattgcctccggtgagaagctcaactcctacattgactacctgctctccgaggcccagaccctcaccgaccagcagctgctcatgtctctgtgggagcccatcattgagtcctccgacaccaccatggtcaccaccgagtgggccatgtacgagctcgccaagaaccccaagctccaggaccgactctaccgagacatcaagtctgtctgtggctccgagaagatcaccgaggagcacctgtcccagctcccctacatcactgccatcttccacgagactctccgacgacactctcccgtccccatcatccctctccgacacgtccacgaggacaccgttctgggtggctaccacgtccccgccggtaccgagctcgctgtcaacatctacggctgcaacatggacaagaacgtctgggagaaccccgaggagtggaaccccgagcgattcatgaaggagaacgagactattgacttccagaaaaccatggcctttggtggtggcaagcgagtctgcgccggctctctccaggctctgctgaccgcctccattggtattggccgaatggtccaggagttcgagtggaagctcaaggacatgacccaggaagaggtcaacaccattggcctcaccacccagatgctccgacctctccgagccatcatcaagccccgaata

SEQ ID NO: 146 - DNA, 1566 bp, Stevia rebaudiana
atgggtctgttccccctcgaggactcctacgctctggtctttgagggcctcgccatcaccctcgccctctactacctgctctccttcatctacaagacctccaagaaaacctgcactcctcccaaggcctccggtgagcaccccatcaccggccacctcaacctgctctccggctcttccggcctcccccacctcgccctcgcctctctggctgaccgatgtggtcccatcttcaccatccgactcggtatccgacgagtcctcgttgtctccaactgggagattgccaaggagatcttcaccacccacgatctcattgtctccaaccgacccaagtacctggctgccaagattctcggtttcaactacgtttccttctcctttgccccctacggcccctactgggtcggtatccgaaagatcattgccaccaagctcatgtcctcttctcgactccagaagctccagttcgtccgagtctttgagctcgagaactccatgaagtccatccgagagtcttggaaggagaagaaggacgaggaaggcaaggttctggtcgagatgaagaagtggttctgggagctcaacatgaacattgttctgcgaactgttgctggtaagcagtacaccggtaccgtcgacgacgccgatgccaagcgaatctccgagctcttccgagagtggttccactacaccggccgatttgttgtcggtgacgccttccccttcctcggctggctcgatctcggtggctacaagaaaaccatggagctcgtcgcctcccgactcgactccatggtcagcaagtggctcgacgagcaccgaaagaagcaggccaacgacgacaagaaagaggacatggacttcatggacatcatgatctccatgaccgaggccaactctcccctcgagggttacggtaccgacaccatcatcaagaccacctgcatgaccctcattgtctccggtgtcgacaccacctccattgtcctgacctgggctctgtctctgctgctcaacaaccgagacactctcaagaaggcccaggaagagctcgacatgtgtgtcggcaagggccgacaggtcaacgagtccgatctggtcaacctcatctacctcgaggctgttctcaaggaagctctgcgactctaccccgctgccttcctcggtggtccccgagccttcctcgaggactgcactgttgccggctaccgaatccccaagggtacctgtctgctcatcaacatgtggaagctccaccgagatcccaacatctggtccgacccctgcgagttcaagcccgagcgattcctgacccccaaccagaaggacgttgatgtcattggtatggacttcgagctcatccccttcggtgccggccgacgatactgccccggtacccgactcgccctccagatgctgcacattgttctcgccactctgctccagaactttgagatgtccacccccaacgacgcccccgtcgacatgactgcttccgtcggtatgaccaacgccaaggcttctcctctcgaggtcctcctgtctccccgagtcaagtggtca

SEQ ID NO: 147 - DNA, 1443 bp, Stevia rebaudiana
atggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaac

SEQ ID NO: 148 - DNA, 1380 bp, Stevia rebaudiana
atggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcc

SEQ ID NO: 149 - DNA, 1374 bp, Stevia rebaudiana
atggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttg

SEQ ID NO: 150 - DNA, 2130 bp, Stevia rebaudiana
atgcagtccgactccgtcaaggtcagccccttcgatcttgtctccgccgccatgaacggcaaggccatggagaagctcaacgcctccgagtccgaggaccccaccaccctccccgctctcaagatgctcgtcgagaaccgagagctcctcaccctcttcaccacctccttcgccgttctcattggctgtctggtctttctcatgtggcgacgatcttcctccaagaagctcgtccaggaccccgtcccccaggtcattgttgtcaagaagaaggagaaggagtccgaggtcgacgacggcaagaagaaggtttccatcttctacggtactcagaccggtactgccgagggtttcgccaaggctctcgtcgaggaagccaaggtccgatacgaaaagacctccttcaaggtcatcgatctcgatgactacgctgctgacgacgacgagtacgaggagaagctcaagaaggagtctctcgccttcttcttcctggccacctacggtgacggtgagcccactgacaacgccgccaacttctacaagtggttcaccgagggtgacgacaagggcgagtggctcaagaagctccagtacggtgtctttggcctcggtaaccgacagtacgagcacttcaacaagattgccattgttgtcgacgacaagctgaccgagatgggcgccaagcgactcgttcccgtcggcctcggtgatgatgaccagtgtatcgaggacgacttcaccgcctggaaggagctcgtctggcccgagctcgaccagctgctgcgagatgaggacgacacttccgtcaccactccctacaccgctgctgttctcgagtaccgagttgtctaccacgacaagcccgctgactcctacgccgaggaccagacccacaccaacggccacgttgtccacgacgcccagcacccctctcgatccaacgttgccttcaagaaggagctccacacctcccagtccgaccgatcttgcacccacctcgagtttgacatctcccacactggtctgtcttacgaaaccggcgaccacgtcggtgtctactccgagaacctctccgaggttgtcgacgaggctctcaagctgctcggtctgtctcccgacacctacttctccgtccacgccgataaagaggacggcacccccatcggtggtgcttctctgcctcctccctttcccccttgcactctgcgagatgctctgacccgatacgccgacgttctctcttctcccaagaaggttgctctgctggccctcgccgcccacgcctccgacccctccgaggccgaccgactcaagttcctcgcctctcccgctggtaaggacgagtacgcccagtggatcgtcgccaaccagcgatctctgctcgaggtcatgcagtccttcccctctgccaagccccctctgggtgttttcttcgccgccgttgctccccgactccagccccgatactactccatctcttcttctcccaagatgtcccccaaccgaatccacgtcacctgtgctctggtctacgaaaccacccccgccggccgaatccaccgaggcctctgttccacctggatgaagaacgccgtccccctgaccgagtcccccgactgctcccaggcttccatcttcgtccgaacctccaacttccgactccccgttgaccccaaggtccccgtcatcatgatcggtcccggtaccggtctggcccccttccgaggcttcctgcaggagcgactcgctctcaaggagtccggcaccgagctcggttcctccatcttcttctttggctgccgaaaccgaaaggtcgacttcatctacgaggacgagctcaacaactttgtcgagactggtgctctctccgagctcattgttgccttctcccgagagggtaccgccaaggagtacgtccagcacaagatgtcccagaaggcctccgacatctggaagctcctctccgagggtgcctacctctacgtctgcggtgacgccaagggtatggccaaggatgtccaccgaaccctgcacaccattgtccaggagcagggctctctcgactcttccaaggccgagctctacgtcaagaacctccagatgtccggccgatacctccgagatgtgtgg

SEQ ID NO: 151 - DNA, 2397 bp, Lactuca sativa
atgaaaaccatgatctcttctcccatccccgctttccacccccgattctctcctgctgctggctctcgacgactctcccccatcctcccctcttccggctccgtcgttctgaccggctccaagacccagtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 152 - DNA, 2271 bp, Lactuca sativa
atgtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 153 - DNA, 2283 bp, Picea glauca
atgaagatgtccaagtccgtcgaggtccagcactgcgccgtccagttcctgtcctccaccaccgaccagattgagatccgagagcgaaacctccagatctccaccgaggccatgaagatgaagtcttggatcgagactgtcaagtacattctgcagtccatggaggacggtgagatcaccatctctgcttacgacactgcctggatcgccctcgtccccgctctcaacggctcttccgagccccagttcccctcttctctgcagtggctcatcaacaaccagctccaggacggctcttggggtgaccccctcatgttcctcatccgagatcgaatcatcaacaccctcgcctgtgtccttgctctcaagacctggaacatccactctctcggtgtcaacaagggtctgtccttcctccagacctacatccccaagatgaacgacgagcacgacgcccacacccccgttggctttgagattgtctttcctgctctcatggaggacgccaagatcatggagctcgatctgccctacgacgccgagttcctccagaagatctacgacgagcgagatctcaagatgaagcgaatccccatgaaggttctgcacgagttcccctccactctgctccactctctcgagggcctccgagacaaggtcaactgggaggagctcctcaagctccagtccaagaacggttccttcctcttctcccccgcctccaccgcctgtgctctggcccagacctccgacaccaactgtctgcgatacctcaacgagatcaccaagaagtacgacggtggtgctcccaacgtctaccccgttgacctctttgagcgactctggaccgtcgaccgaattgagcgactcggtattgcccgatactttgagtccgagatcaccgactctctcgagtacgtctaccgatactggaccaaccagggtattggctgggcccgagactcccccgtcaaggacgttgacgacacctccatggccttccgactgctgcgatcccacggcttcgatgtcactgccgaggccttcaaccacttcaagcaggacgaccagttcttctgcttctttggccagaccaagcagaccgtcaccggtatgtacaacctctaccgagcctcccagttctccttccccggtgagtccatcctcgaggaagctcgagtctttaccaagaacttcctcgaggagaagcgagctgagaagcagctgcgagacaagtggatcattgccaagggcctcaaggaagaggtcgagtacgctctcaagttcccctggtacgcctctcagcctcgaattgacacccgaatgtacatcaaccagtaccgagttgatgatgtctggatcggtaaggctctctaccgaatgcccattgtcaacaacaagacctacattgagctcgccaaggctgacttcaacatctgccagtccatccaccgaaccgagctccacggtatcatccgatggtaccgagagtccggtctggacgagctcggtctgcgacaggaccagattgtcaagtcttacttcctcgccgccattgccatctacgagcccgacatggcctccgcccgactcgcctgggccaagtctgctgttctcatggctgccatccgaatcttcttctccggtgagaactgctttgcccaccaccgacgacagttcctcgacgccttcacccgatgggacggccgagccatgcgagactcccccaactccgccaagcgactcttctcttgtctcttccgaatggtcaacctcttctccgtcgacggtgttgttgcccagggccgagacatctccggtgatctgcgacaccgatgggagcactggctcgcctccgaggccgaggatctgaccgacgcccaggaccacgagaagctcggtaccgaggctgagattgttgttctgaccgctgctttcctcggccgagagactatctcccccgatctcatctcccaccccgacttctcctccatcatgaaggtcaccaacaccgtctgctctctgctgcgacgaattgccacctacaaggaagagggctgcgactccccctccggtactgaagaggacgaccgactcaagcgacgagctgaagagggtatgggccaccttgtccgagccgtctaccgacaccagtactcccccgtcccctctggtgtcaagcgactctgtctggttgtcggcaagtctttctactacgccgcccactgcaacaacgaggaagtcggcaaccacgttgagactgttctcttccagcccgtgtat

SEQ ID NO: 154 - DNA, 1548 bp, Bradyrhizobium japonicum
atgaacgccctctccgagcacattctgtccgagctccgacgactcctctccgagatgtccgacggtggttccgtcggcccctccgtctacgacaccgcccaggctctgcgattccacggtaacgtcaccggccgacaggacgcctacgcctggctcattgcccagcagcaggctgacggtggctggggttccgccgacttccctctcttccgacacgcccccacctgggctgctctgctcgctctgcagcgagccgaccccctccccggtgctgccgacgccgtccagaccgccacccgattcctccagcgacagcccgacccctacgcccacgccgtccccgaggacgcccccattggtgccgagctcatcctcccccagttctgcggtgaggctgcttctctgctcggtggtgttgccttcccccgacaccccgctctgctccccctccgacaggcctgtctggtcaagctcggtgccgtcgccatgctcccctccggccaccctctgctccactcttgggaggcctggggtacttctcccaccactgcctgccccgacgacgacggctccatcggtatctctcccgctgccaccgccgcctggcgagcccaggctgtcacccgaggctccactccccaggtcggccgagccgatgcctacctccagatggcctctcgagccacccgatccggtatcgagggtgttttccccaacgtctggcccatcaacgtctttgagccctgctggtccctctacaccctccacctcgccggcctcttcgcccaccccgctctcgccgaggctgtccgagtcatcgtcgcccagctcgacgcccgactcggtgtccacggtcttggccccgctctgcactttgctgccgacgccgacgacaccgccgttgctctctgtgttctgcacctcgccggccgagatcccgccgtcgatgctctgcgacactttgagattggtgagctcttcgtcaccttccccggtgagcgaaacgcctccgtttccaccaacatccacgccctccacgccctccgactcctcggcaagcccgctgccggtgcctccgcctacgtcgaggccaaccgaaacccccacggtctgtgggacaacgagaagtggcacgtcagctggctctaccccaccgcccacgccgttgctgctctcgcccagggcaagccccagtggcgagatgagcgagctctggctgctctgctccaggcccagcgagatgacggtggctggggtgctggccgaggctccaccttcgaggagactgcctacgccctcttcgccctccacgtcatggacggctctgaagaggccaccggccgacgacgaatcgcccaggttgttgcccgagctctcgagtggatgctcgcccgacacgccgcccacggtctgccccagacccctctgtggatcggtaaggagctctactgccccacccgagttgtccgagttgccgagctcgccggtctgtggctcgctctgcgatggggccgacgagtcctcgccgagggtgccggtgctgcccca

SEQ ID NO: 155 - DNA, 2364 bp, Lactuca sativa
atgaacattgcccagatcacctcttctgccatgctcgtcccctcttcccacattccccaccgatcttgggtcgtcaactgctgcatggtccagtacaacccctccggtctgcgaaccgcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 156 - DNA, 2250 bp, Lactuca sativa
atggcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 157 - DNA, 2271 bp, Picea glauca
atgaagcgagagcagtacaccatcctcaacgagaaggagtccatggccgaggagctcatcctccgaatcaagcgaatgttctccgagattgagaacacccagacctccgcctccgcctacgacaccgcctgggttgccatggtcccctctctcgactcctcccagcagccccagttcccccagtgcctctcttggatcatcgacaaccagctcctcgacggctcttggggtatcccctacctcatcatcaaggaccgactctgccacaccctcgcctgtgtcattgctctgcgaaagtggaacgccggtaaccagaacgtcgagactggtctgcgattcctgcgagagaacattgagggtattgtccacgaggacgagtacacccccattggtttccagatcatcttccccgccatgctcgaggaagctcgaggtctgggtctggagctcccctacgatctgacccccatcaagctcatgctgacccaccgagagaagatcatgaagggcaaggccattgaccacatgcacgagtacgactcctctctcatctacaccgtcgagggtatccacaagattgtcgactggaacaaggttctcaagcaccagaacaaggacggctctctcttcaactccccctctgccaccgcctgtgctctcatgcacacccgaaagtccaactgtctggagtacctctcttccatgctccagaagctcggtaacggtgtcccctccgtctaccccatcaacctctacgcccgaatctccatgattgaccgactccagcgactcggtctggcccgacacttccgaaacgagatcatccacgccctcgacgacatctaccgatactggatgcagaaggagacttctcgagagggcaagtctctcacccccgacattgtttccacctccattgccttcatgctgctgcgactccacggctacgatgtccccgctgacgttttctgctgctaccacctccactccattgagcagtccggtgaggctgtcactgccatgctgtctctgtaccgagcctcccagatcatgttccccggtgagactatcctcgaggagatcaagaccgtttcccgaaagtacctcgacaagcgaaaggagaacggtcgaatctactaccacaacattgtcatgaaggacctccgaggtgaggttgagtacgccctctccgtcccctggtacgcctctctcgagcgaatcgagaaccgacgatacattgaccagtacggtgtcaacgacacctggatcgccaagacctcttacaagatcccctgtatctccaacgatctgttcctggctctggccaagcaggactacaacatctgtcaggccatccagcagaaggagctccgagagctcgagcgatggttcgccgacaacaagttctcccacctcaactttgcccgacagaagctcatctactgctacttctccgctgctgccactctcttctctcccgagctctctgctgctcgagttgtctgggccaagaacggtgtcatcaccaccgttgttgacgacttcttcgatgttggtggctcctccgaggagatccactcttttgtcgaggctgtccgagtctgggatgaggctgccaccgacggtctgtccgagaacgtccagatcctcttctccgctctgtacaacaccgttgacgagattgtccagcaggcctttgtctttcagggccgagacatctccatccacctgcgagagatctggtaccgactcgtcaactccatgatgaccgaggcccagtgggcccgaacccactgcatcccctccatgcacgagtacatggagaacgccgagccttccattgctctcgagcccattgttctctcctctctctactttgtcggccccaagctgtccgaggagatcatctgccaccccgagtactacaacctcatgcacctgctcaacatctgtggccgactcctcaacgatatccagggctgcaagcgagaggcccaccagggcaagctcaactccgtcactctctacatggaggagaactccggcaccaccatggaggatgccattgtctacctgcgaaagaccatcgacgagtcccgacagctcctcctcaaagaggttctgcgaccttccattgtcccccgagagtgcaagcagctccactggaacatgatgcgaatcctccagctcttctacctcaagaacgacggtttcacctcccccaccgagatgctcggctacgtcaacgccgtcattgtcgaccccatattg

SEQ ID NO: 158 - DNA, 900 bp, Bradyrhizobium japonicum
atgatccagaccgagcgagccgtccagcaggttctcgagtggggtcgatctctgaccggctttgccgacgagcacgccgtcgaggccgtccgaggtggtcagtacatcctccagcgaatccacccctctctgcgaggtacctccgcccgaaccggccgagatccccaggacgagactctcattgtcaccttctaccgagagctcgctctgctcttctggctcgacgactgcaacgatctcggcctcatctcccccgagcagctcgccgccgtcgagcaggctctcggccagggtgtcccctgtgctctgcccggtttcgagggctgtgccgtcctccgagcttctctcgccaccctcgcctacgaccgacgagactacgcccagctcctcgacgacacccgatgctactccgctgctctgcgagctggtcacgcccaggctgttgctgccgagcgatggtcctacgccgagtacctccacaacggtatcgactccattgcctacgccaacgttttctgctgtctgtctctgctctggggcctcgacatggccactctgcgagcccgacccgccttccgacaggttctgcgactcatctccgccatcggtcgactccagaacgatctccacggctgcgacaaggaccgatccgccggtgaggctgacaacgccgtcattctgctcctccagcgataccccgccatgcccgttgtcgagttcctcaacgacgagctcgccggccacacccgaatgctgcaccgagtcatggccgaggagcgattccccgctccctggggtcctctcattgaggccatggctgccatccgagtccagtactaccgaacctccacctcccgataccgatccgatgccgtccgaggtggtcagcgagctcccgcc

SEQ ID NO: 159 - DNA, 2838 bp, Phaeosphaeria sp
atgttcgccaagttcgacatgctcgaggaagaggcccgagctctggtccgaaaggtcggtaacgccgtcgaccccatctacggtttctccaccacctcctgccagatctacgacaccgcctgggccgccatgatctccaaagaggagcacggtgacaaggtctggctcttccccgagtccttcaagtacctcctcgagaagcagggtgaggacggctcttgggagcgacacccccgatccaagaccgtcggtgttctcaacaccgccgccgcctgtctggctctcctccgacacgtcaagaaccccctgcagctgcaggacattgctgcccaggacatcgagctccgaatccagcgaggtctgcgatctctcgaggagcagctcatcgcctgggatgacgttctggacaccaaccacattggtgtcgagatgattgtccccgctctgctcgactacctccaggccgaggacgagaacgtcgacttcgagtttgagtcccactctctgctcatgcagatgtacaaggagaagatggcccgattctcccccgagtctctctaccgagctcgaccctcttctgctctgcacaacctcgaggctctcatcggtaagctcgatttcgacaaggtcggccaccacctctacaacggctccatgatggcctccccctcttccactgccgccttcctcatgcacgcctctccctggtcccacgaggccgaggcctacctccgacacgtctttgaggctggtaccggcaagggctccggtggtttccccggtacctaccccaccacctactttgagctcaactgggtcctctccaccctcatgaagtccggcttcactctctccgatctcgagtgcgacgagctctcctccattgccaacaccatcgccgagggtttcgagtgcgaccacggtgtcatcggtttcgctccccgagccgtcgacgttgatgacactgccaagggtctgctcaccctcaccctcctcggtatggacgagggtgtctcccccgctcccatgattgccatgttcgaggccaaggaccacttcctgaccttcctcggtgagcgagatccctccttcacctccaactgccacgttctgctctctctgctccaccgaaccgacctcctccagtacctcccccagatccgaaagaccaccaccttcctctgtgaggcctggtgggcctgcgacggccagatcaaggacaagtggcacctctcccacctctaccccaccatgctcatggtccaggcctttgccgagatcctcctcaagtccgccgagggtgagcctctgcacgacgcctttgacgccgccactctgtctcgagtctccatctgtgttttccaggcctgtctgcgaactctgctcgcccagtcccaggacggctcttggcacggccagcccgaggcttcttgctacgccgtcctcaccctcgccgagtccggccgacttgttctgctccaggctctgcagccccagattgctgctgccatggagaaggctgctgatgtcatgcaggctggtcgatggtcttgttccgaccacgactgtgactggacctccaagaccgcctaccgagtcgacctcgttgctgctgcttaccgactcgccgccatgaaggcctcttccaacctcaccttcaccgtcgacgacaacgtttccaagcgatccaacggtttccagcagctcgtcggccgaaccgacctcttctccggtgtccccgcctgggagctccaggcctctttcctcgagtccgctctgtttgtccctctgctccgaaaccaccgactcgatgtctttgaccgagatgatatcaaggtttccaaggaccactacctcgatatgatccccttcacctgggtcggctgcaacaaccgatctcgaacctacgtttccacctccttcctcttcgacatgatgatcatctccatgctcggctaccagattgacgagttcttcgaggctgaggctgcccccgccttcgcccagtgcatcggtcagctccaccaggttgttgacaaggtcgtcgacgaggtcattgacgaggttgtcgacaaggttgtcggtaaggtcgtcggtaaggtcgtcggcaaggtcgtcgacgagcgagtcgactcccccacccacgaggccatcgccatctgcaacatcgaggcttctctgcgacgattcgtcgaccacgttctccaccaccagcacgttctgcacgcctcccagcaggagcaggatatcctctggcgagagctccgagccttcctgcacgcccacgttgtccagatggccgacaactccactctcgctcctcccggccgaaccttctttgactgggtccgaaccactgctgccgaccacgttgcctgtgcctactccttcgccttcgcctgctgcatcacctccgccaccattggccagggccagtccatgtttgccaccgtcaacgagctctacctggtccaggctgctgcccgacacatgaccaccatgtgccgaatgtgcaacgacattggctccgtcgaccgagacttcattgaggccaacatcaactccgtccacttccccgagttctccactctgtctctcgttgctgacaagaagaaggctctggcccgactcgccgcctacgagaagtcttgtctgacccacaccctcgaccagtttgagaacgaggttctccagtctccccgagtctcctccgccgcctccggtgacttccgaacccgaaaggtcgccgttgtccgattcttcgccgatgtcactgacttctacgaccagctctacatcctccgagatctgtcctcctctctcaagcacgtcgggaca

SEQ ID NO: 160 - DNA, 2856 bp, Gibberella fujikuroi
atgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaa

SEQ ID NO: 161 - DNA, 1533 bp, Lactuca sativa
atggatctgcagaccatggcccccatgggctctgctgccattgccatcggtggtcccgctgttgccgttgctggtggtatctctctgctcttcctcaagtctttcctgtcccagcagcccggcaaccccaaccacctcccctccgtccccgctgtccccggtgtccctctgctcggtaacctgctcgagctcaaggagaagaagccctacaagaccttcaccaagtgggccgagacttacggccccatctactccatcaagactggtgccacctccatggtcgttgtcaactccaaccagctcgccaaagaggccatggtcacccgattcgactccatctccacccgaaagctctccaaggctctccagattctcactgctgacaagaccatggttgccatgtccgactacgacgactaccacaagaccgtcaagcgaaacctgctcacctccatcctcggtcccgctgcccagaagcgacaccgagcccaccgagatgccatgggtgacaacctgtctcgacagctccacgctcttgctctcaactctcctcaagaggccatcaacttccgacagatcttccagtccgagctcttcactctcgccttcaagcagacctttggccgagacattgagtccatcttcgtcggtgatctcggtaccaccatgacccgagaggagatgttccagatcctcgttgtcgaccccatgatgggtgccattgacgttgactggcgagacttcttcccctacctcaagtggatccccaacgccaagctcgaggagaagattgagcagatgtacatccgacgaaaggccgtcatgaaggccgtcatccaggagcaccgaaagcgaattgactccggcgagaacctcgactcttacattgacttcctgctcgccgaggcccagcctctgaccgagaagcagctcctcatgtctctgtgggagcccatcattgagacttccgacaccaccatggtcaccaccgagtgggccatgtacgagctctccaagcaccccaacaagcagcagcgactctacaacgagatccgaaacatctgtggttccgagaagatcaccgaggagaagctctgcaagatgccctacctgtctgctgttttccacgagactctgcgagtccactcccccgtttccatcatccccctgcgatacgtccacgagaacaccgagctcggcggctaccacgtccccgccggcaccgagctcgccgtcaacatctacggctgcaacatggagcgagagatctgggagaaccccgaggagtggtcccccgagcgattcctcgccgagaacgagcccgtcaacctgcagaaaaccatggcctttggtgctggtaagcgagtctgcgctggtgccatgcaggccatgctgctcgcctgtgtcggtattggccgaatggtccaggagtttgagtggcgactcaaggacgacgttgaagaggatgtcaacaccctcggcctcaccacccagcgactcaaccccatgctcgccgtcatcaagccccggaat

SEQ ID NO: 162 - DNA, 1536 bp, Lactuca sativa
atggacggtgtcattgacatgcagaccatccccctgcgaactgccattgccattggtggtactgctgttgctctcgttgttgctctctacttctggttcctgcgatcttacgcctccccctctcaccactccaaccaccttcctcccgtccccgaggtccccggtgtccccgtcctcggtaacctgctccagctcaaggagaagaagccctacatgaccttcaccaagtgggccgagatgtacggccccatctactccatccgaaccggtgccacctccatggttgttgtctcttccaacgagattgccaaggaagttgttgtcacccgattcccctccatctccacccgaaagctctcttacgctctcaaggtcctcactgaggacaagtccatggttgccatgtccgactaccacgactaccacaagaccgtcaagcgacacattctcaccgccgtcctcggccccaacgcccagaagaagttccgagcccaccgagacaccatgatggagaacgtttccaacgagctccacgccttcttcgagaagaaccccaaccaggaagtcaacctgcgaaagatcttccagtctcagctctttggtctggccatgaagcaggctctcggcaaggatgtcgagtccatctacgtcaaggatctcgagactaccatgaagcgagaggagatcttcgaggttctggtcgtcgaccccatgatgggtgccattgaggtcgactggcgagacttcttcccctacctcaagtgggtccccaacaagtctttcgagaacatcatccaccgaatgtacacccgacgagaggctgtcatgaaggctctcatccaggagcacaagaagcgaattgcctccggtgagaacctcaactcctacattgactacctgctctccgaggcccagaccctcaccgacaagcagctcctcatgtctctgtgggagcccatcatcgagtcctccgacaccaccatggtcaccaccgagtgggccatgtacgagctcgccaagaaccccaacatgcaggaccgactctacgaggagatccagtctgtctgtggctccgagaagatcactgaggagaacctgtcccagctcccctacctctacgccgttttccaggagactctgcgaaagcactgccccgtccccatcatgcccctgcgatacgtccacgagaacaccgtcctcggtggctaccacgtccccgctggtaccgaggttgccatcaacatctacggctgcaacatggacaagaaggtctgggagaaccccgaggagtggaaccccgagcgattcctgtccgagaaggagtccatggacctctacaagaccatggcctttggtggtggcaagcgagtctgtgccggctctctgcaggccatggtcatctcctgcattggtatcggtcgactcgtccaggactttgagtggaagctcaaggacgatgctgaggaagatgtcaacaccctcggcctcaccacccagaagctccaccctctgctcgccctcatcaacccccggaaa

SEQ ID NO: 163 - DNA, 1575 bp, Sphaceloma manihoticola
atgatggacgacaccacctccccctactccacctaccactccgtccgatccatccgaaaccagtccgcctgggctctggcccccattgccgtctttatctgctacgttgttctgcgacacaaccgaaagtccgtccccgctgcctctgctggttcccactccatcctcgagcccctgtggctcgcccgactccgattcatccgagactctcgattcatcatcggtcagggctactccaagttcaaggacaccatcttcaaggtcaccaaggtcggtgccgatatcattgttgttgctcccaagtacgtcgaggagatccgacgactctcccgagacaccggccgatccgtcgagcccttcatccacgactttgccggtgagctcctcggtggcctcaacttcctcgagtccgatctccagacccgagttgtccagcagaagctcacccccaacctcaagaccattgtccccgtcatggaggacgagatgcactacgctctcgtttccgagctcgactcttgtctcgatggttccgagcactggacccgagtcgacatgatccacatgctctcccgaattgtctctcgaatctccgcccgaatcttcctcggccccaagtactgccgaaacgatctgtggctcaagaccactgccgagtacaccgagaacctcttcctgaccggtactctgctccgattcgtcccccgaatgctccagaagtggatcgctcctctgctcccctctttccgacagctccaggagaaccgacaggccgcccgaaagatcatctccgagattctgaccgaccaccagcccgagaagcacgacgagacttccgacaacggtgacccctaccccgacattctcaccctcatgttccaggctgcccgaggtaaggagaaggacattgaggacattgcccagcacactctgctcctctctctgtcctccatccacaccactgctctgaccatgacccaggctctctacgatctctgtgcctacccccagtacctcgaccccgtcaagcacgagattgccgacactctgcagtccgagggctcttggtccaaggccatgctcgacaagctccacatgatggactctctgctccgagagtcccagcgactctctcccgtctttctgctcaccttcaaccgaatcctccacacccctctgaccctctccaacggtatccacctccccaagggtacccgaattgccgccccctccgacgccatcctcaacgacccctctctggtccccggcccccagcccgctgacaccttcgaccccttccgatacatcaaccactccaccggtgatgccaagaaaaccaagaccaacttccagaccacctctctgcagaacatggcctttggctacggtaagtacgcctgccccggccgattctacgttgccaacgagatcaagctcgttctcggccacctgctcatgcactacgagttcaagttccctcccggtatgggccgacccgtcaactccactgtcgacaccgacatgtaccccgatctcggtgcccgactcctcgtccgaaagcgaaagatggaggag

SEQ ID NO: 164 - DNA, 1440 bp, Artemisia annua
atgcccatgaccgtcatgctgctctttgttttcctgctcttcattgccatctgtttcttcctcgtccaccgacacaactccaccaccaccaagaacctgcctcccggctccttcggctggcccttcattggtgagactctcgcctacatccgatccaagcgaggtggtgaccccgagcgattcaccaaggagcgaatcgagaagtacggctccactctggtctttaagacctccgttgccggtgagcgaatggccgttttctgcggtcccgagggtaacaagttcctctttggcaacgagaacaagctcgttgcttcttggtggcccaactccgtccgaattctcttcgagaagtgtctgatcaccatccgaggtgacgaggccaagtggctccgaaagatgatgttcgcctacctcggtcccgatgctctgtccaaccgatacaccggtaccatggaggttgtcacccgactccacatccagaaccactggcagggcaagtccgagctcaaggtctttgagactgtccgaccttacctcttcgagctcgcctgccgactcttcctgtctctcgacgaccccaagcacgttgccgagctcggtaccctcttcaacaccttcctcaagggtctgaccgagctccccatcaacatccccggtacccgattctaccgagccaagcgagctgccaacgccatcaagaagcagctcattgtcatcatcaagcagcgacgacaggctctcaagcaagaggaccagtcctcctccttcgaggacctcctctcccacctccttgtctcctccgacgagaacggccgattcctgtccgaggctgagattgccaacaacgttctgctcctcctcttcgccggccacgacacttctgctgtctccatcactctgctcatgaagtctctggccgagcacccccaggtctacgacaacgtcctcaaggagcagctcggtattctcgaggccaaggctcccggtgagatgctcaactgggaggatatccagaagatgcgatactcttggtacgttgtctgcgaggtcatgcgactcattcctcccgttgtcggctctttccgagaggctctggtcgactttgagtacgccggctacaccatccccaagggctggaagatcatctggtccgccgtcatgacccacaaagaggagaacaacttccccaacgccaccaagttcgacccctctcgattcgagggtgctggtcccacccccttcacctacgtccccttcggtggtggcccccgaatgtgcctcggcaaggagctcgcccgagtccgaatcctcgtctttctgcacaacatcatgaccaagttcaagtgggatctgctcatccccgacgagaagattggctacgaccccctcgccacccccgtcaagggtctgcccgtccgactccacccccaccaggtt

SEQ ID NO: 165 - DNA, 1365 bp, Ricinus communis
atggagctcgtcatgttccccgttctggctctcgtttccactctcttcctgctcgccctccacttcatcatccgaaccctcaaggagcgactctttggctctcccaacctgcctcccggccgactcggctggcccctcattggtgagactcccgccttcttccgagctggctttgaggccaagcccgagaagttcatcggtgagcgaatggagaagtacgactcccgagtctttaagacctctctgctcggcaagcccttcgccgtcatctccggtaccgccggccacaagttcctcttctccaacgagaacaagctcgtcaacctgtggtggcccgagtccgtccgaatgctcttcaagtctgctctcgtttccgttgtcggtgacgaggccaagcgaatccgaaagatgctcatgaccttcctcggcctcgatgctctcaagaactacaccgagcgaattgacatggtcacccagcagcacatccgaacctactgggagggtaaagaggaagtcaccgtctactccactctcaagctctacaccttcactctggcctgcaacctcttcgcctccatcaacgaccccgagcgactctccaagctcggtgcccacttcgacgtctttgtcaagggtgtcatctctctgcccatctccatccccggtacccgactctacaagtccatgaaggctgccaacgccatccgagaggagctcaagctcattgtccgagatcgaaaagaggctctcgagcgaaagatggcctcccccacccaggatctgctctcctacctgctcgtcgactccgacaccaacggccgattcctgtccgagatggagattctcgacaacatcatgctgctcctctacgctgagcagctcgagattgccaactccaagaagcccggtgagctgctccagtgggaggacgtccagaagatgcgatactcttggaacgtcatctccgaggttctgcgactgtctcctcccgtttcttctgcctaccgacacgccattgttgacttcacctacgagggttacaccatccccaagggctggcagctcttcacctccttcggtaccacccaccgagatcccgctctcttccccaaccccgagcgattcgacgcctctcgattcgagggtaacggtcctccctcctactcctacatccccttcggtggtggtccccgaatgtgcattggctacgagtttgcccgactcgagatgctcatcttcctgcacaacatcatcaagcgattcaagtgggacattctcatccccgacgagcagtttggctacaaccccctgctcgccccctcccagggtttccccgtccgactgcgaccccaccactcccatctc

SEQ ID NO: 166 - DNA, 1428 bp, Stevia rebaudiana
atgatccaggttctgacccccatcctcctcttcctcatcttcttcgttttctggaaggtctacaagcaccaaaagaccaagatcaacctgccccctggctccttcggctggcccttcctcggtgagactcttgctctgctccgagccggctgggactccgagcccgagcgattcgtccgagagcgaatcaagaagcacggctctcctctcgttttcaagacctctctcttcggtgaccgattcgccgttctctgtggtcccgctggtaacaagttcctcttctgcaacgagaacaagctcgttgcctcttggtggcccgtccccgtccgaaagctcttcggcaagtctctgctcaccatccgaggtgacgaggccaagtggatgcgaaagatgctgctctcctacctcggtcccgatgcctttgccacccactacgctgtcaccatggacgttgtcacccgacgacacattgacgtccactggcgaggcaaggaagaggtcaacgttttccagaccgtcaagctctacgcctttgagctcgcctgccgactcttcatgaacctcgacgaccccaaccacattgccaagctcggctctctcttcaacatcttcctcaagggtatcatcgagctccccattgacgttcccggtacccgattctactcctccaagaaggctgctgctgccatccgaatcgagctcaagaagctcatcaaggcccgaaagctcgagctcaaggaaggcaaggcctcctcctcccaggatctgctgtcccacctgctcacctcccccgacgagaacggtatgttcctgaccgaggaagagattgtcgacaacattctgctcctcctctttgccggccacgacacctctgctctgtccatcactctgctcatgaaaactctcggtgagcactccgatgtctacgacaaggtcctcaaggagcagctcgagatctccaagactaaagaggcctgggagtctctcaagtgggaggacatccagaagatgaagtactcctggtccgtcatctgcgaggtcatgcgactcaaccctcccgtcatcggtacctaccgagaggctctggtcgacattgactacgccggctacaccatccccaagggctggaagctccactggtccgctgtctccacccagcgagatgaggccaactttgaggacgtcacccgattcgacccctctcgattcgagggtgccggtcccactcccttcacctttgtccccttcggtggtggtccccgaatgtgtctcggcaaggagtttgcccgactcgaggttctggccttcctgcacaacattgtcaccaacttcaagtgggatctgctcatccccgacgagaagattgagtacgaccccatggccacccccgccaagggtctgcccatccgactccacccccaccaggtg

SEQ ID NO: 167 - DNA, 1575 bp, Arabidopsis thaliana
atggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgta

SEQ ID NO: 168 - DNA, 1437 bp, Ixeris dentata
atggacgccgttgccgtcaactccgagactatgtcccacgttgtctttatccccttccccgcccagtcccacatcaagtgcatgctcaagctcgcccgactgctgcaccacaagggtctgcacatcacctttgtcaacaccgagctcaaccacaaccagctgctgtcctccggtggtcccaactctctcgacggtgagcccggtttccgattcaagaccatccccgatggtgtccccgagggtgctcccgacttcatgtacgctctgtgtgactccgttctcaacaagatgctcgaccccttcgtcgatctcattggccgactcgagtcccccgccacctgtatcatcggtgacggtatgatgcccttcactgttgctgctgccgagaagctcaagctccccatcatgcacttctggaccttccccgctgctgccttcctcggctactaccaggcccccaacctcattgagaagggcttcatccctcccaaggacgagtcttggtccaccaacggctacctcgagactgttgtcgactccatctccggtctggagggtttccgaatccgagacatccccgcctacttccgaaccaccgaccccaacgactccgacttcaactacatcattgagtgtgtcaaggccatccgaaaggtttccaacattgttctccacacctttgaggagctcgagtccaccatcatcaaggctctgcagcccatgatcccccacgtctacaccattggccccctcgagctcctcctcaaccccatcaagctcgaagaggagactgagaagctcgatatcaagggctactctctgtggaaggaagatgacgagtgcctcaagtggctcgactccaaggagcccaactccgtcatctacgtcaacttcggctctctcatctccatgtccaaggagcagctcgccgagtttggctggggtctggtcaactccaaccactgcttcctctgggtcatccgacgagatctggttgtcggtgactctgctcctctgcctcccgagctcaaggagcgaatcaacgagcgaggtttcattgcctcttggtgcccccaggagaaggtcctcaagcactcctccgtcggtggtttcctcacccactgtggctggggctccatcatcgagtctctgtccgccggtgtccccatgctctgctggccctacctctgggaccagcccaccaactgccgacaggcctgcaaggagtgggaggtcggtctggagattgagggtaacgtcaacaaggacgaggtcgagcgactcacccgagagctcattggtggtgagaagggcaagcagatgcgatccaaggccctcgagtggaagaagaagattgagattgccaccggccccaagggctcttcttctctcaacgtcgagcgactggccaacgacatcaacatgttctcccgaaat

SEQ ID NO: 169 - DNA, 1446 bp, Ricinus communis
atgggctccattgtccgagatcacgacaagccccacgttgtctgtgtcccctaccccgcccagggccacgtcaaccccatggtcaagctcgccaagctcctccactacaacgacttccacgtcacctttgtcaacaccgagtacaaccaccgacgactcctcaactcccgaggcccctcttctctcgacggcctccccgacttccgattcgaggccatctccgacggtctgcccccttccgacgccaacgccacccaggatatcccctctctctgtgactccacctccaagaactctctggcccccttccgaaacctgctgctcaagctcaagtcctccgactctctgcctcccgtcacctgtatcatctccgacgcctgcatgtccttcaccctcgatgctgctgaggagttcggtatccccgagatcctcttctggaccccctcttcttgtggtgttctcggctactcccagtaccacactctcattgagaagggtctgactcccctcaaggacgcctcctacctgaccaacggctacctcgagactaccctcgactggatccccggtatgaaggacatccgattccgagatctgccctctttcatccgaaccaccgaccgaaacgacatcatgctcaacttcgttgtccgagagctcgagcgaacctcccgagcctctgctgttgttttcaacaccttctacgcctttgagaaggacgttctcgacgttctgtccaccatgttccctcccatctactccatcggtcccctccagctcctcgtcgaccagatccccattgaccgaaacctcggtaacattggctccaacctgtggaaggagcagcccgagtgcattgactggctcgacaccaaggagcccaactccgttgtctacgtcaactttggctccatcaccgtcatcactccccagcagatgattgagtttgcctggggtctggcctcttccaagaagcccttcctgtggatcatccgacccgatctggtcattggtgagaacgccatgctccccgctgagtttgtctccgagactaaggaccgaggtatgctcgcctcttggggtccccaggagcagatcctcaagcaccccgctgtcggtggtttcctgtcccacatgggctggaactccaccctcgactccatgtccggtggtgtccccatggtctgctggcccttcttcgccgagcagcagaccaactgccgattcgcctgcaccgagtggggtgtcggtatggagattgacaacaacgtcaagcgagatgaggtcaagaagctcgttgaggtcctcatggacggcaagaagggcaaggagatgaagtccaaggccatggagtggaaaaccaaggctgaggaagctgccaagcccggtggttcctcccacaacaacctcgaccgactcgtcaagttcatcaagggccagaagaat

SEQ ID NO: 170 - DNA, 1374 bp, Ixeris dentata
atggccgaggagcacaacaagaccaacaactcctctccccacgttgtcatcttccccttcccctcccagggccacatcaaccccctcatccagtttgccaagcgactctcctccaagggtgtcaagcccactctcatcaccaccatctacattgccaagacctctccttaccccaactcctccattgttgtcgagcccatctccgacggtttcgacgacggtggtttcaagtccgccacctccgctgagtcctacattgacaccttccaccaggtcggctccaagtctctggccaacctcatccgaaagctcgtcaacgagggcaaccacgttgatgccatcatctacgactccttcgtcacctgggctctcgatgttgccatggagtacggtattgacggtggctgcttcttcacccaggcctgtgccgtcaacaacatctactaccacgtctacaagggtgtcctcgagatccccctgcaggctgctgctcctcccaccgtcaccattctgctccccgagctcccccagctccagctgtgggagactccctcttttgtccacaaccccggcccctaccccggctgggcccacattgtctttaaccagttccccaacatccacaacgcccgatgggttttctccaacaccttcttcaagctcgaggagcaggtcatcaagtggatgcgactcatgtggcctctcatggtcgtcggtcccaccgtcccctccatgtacctcgacaagcgactcgaggacgacgacgactacggtatgtctctgctcaagcccaaccacattgagtgcatgggctggctcaacaacaagcccaagggctccgtcgtctacgtttctttcggctcttacggtgagctcggtgttgcccagatggaggagattgcctggggtctgaacgagtcctccgtcaactacctgtgggttgtccgagagactgagaaggagaagctccccaagtccttcctggccaacggtctgattgtcgagtggtgccgacagctcgaggtcctcgcccacgaggctgttggctgtttcgtcacccactgcggtttcaactcctctctcgagactatctctctcggtgtccccgttgttgccatcccccagtggaccgaccagaccaccaacgccaagtgcctcgaggatatctggggtgtcggtatccgagccaagacccccgtcacccgaaccaacctggtctggtgcatcaaggagatcatggagggtgagcgaggtgctgttgctcgaaagaacgccatcaagtggaaggatctggccattgaggctgtctcccccggcggctcttccgacaaggacatcaacgagtttgtctcccagctctcccccatcaagtgt

SEQ ID NO: 171 - DNA, 1362 bp, Populus trichocarpa
atggacaacaagaagtcccacgtcattgttctgacctaccccgcccagggccacatcaaccccctgctccagtttgccaagcgactcgcctccaagggcctcaaggccactctggccaccacctactacaccgtcaactccatcgacgcccccaccgtcggtgttgagcccatctccgacggtttcgacgagggtggtttcaagcaggcttcttctctcgatgtctacctcgagtccttcaagaccgtcggctcccgaactctgaccgagctcgttttcaagttcaaggcttccggctctcccgtcaactgtgttgtctacgactccatgctcccctgggccctcgacgttgctcgagatctcggtatctacgctgctgccttcatgaccacctctgcttccgtctgctccatgtactggcgaatcgatctcggtctgctgtctctgcccctcaagcagcagaccgccactgtctctctgcccggtctgccccctctcggctgctgtgacctcccctctttcctcgccgagcccacctcccagaccgcctacctcgaggtcatcatggagaagttccactctctcaacgaggacgactgggttttctgcaactccttcgaggacctcgagattgagctcgtcaaggccatgcgaggcaagtggcccctcgtcatggtcggccccatggtcccctccgcctacctcgaccagcagatcgacggtgaccgagcctacggtgcttctctgtggaagcccacctcctcccagtgcttcacctggctcgacaccaagccccctcgatccgtcatctacgtttccttcggctccatgggcaacatctccgccgagcaggttgaggagattgcctggggcctcaaggcttccaaccgacccttcctgtgggtcatgaaggagtccgagaagaagctccccaccggtttcctcaactccgtcggtgagactggtatggttgtctcttggtgcaaccagctcgaggttctcgcccaccaggccattggctgctttgtcacccactgtggctggaactccactctcgagggtctgggcctcggtgtccccatggtctgtgtcaccgagcgatccgaccagcccatgaacgccaagttcgtcgaggatgtctggaaggtcggtgtccgagccaagaaggacgaggttggtattgtcacccgagaggagctcgagaagtgcatccgaggtgtcatggacggtgagaacggtgaggagatcaagcgaaacgccaacaagtggcgagagctcgcccgatctgctgtttccgtcggtggttcctccgacatgaacatcaacgagtttgttgtcaagctgctcgagggcaagaaggga

SEQ ID NO: 172 - DNA, 1377 bp, Nicotiana tabacum
atgaccacccagaaggcccactgtctgatcctcccctaccccgcccagggccacatcaaccccatgctccagttctccaagcgactccagtccaagggtgtcaagatcaccattgctgccaccaagtctttcctcaagaccatgcaggagctgtccacctctgtctccgtcgaggccatctccgacggctacgacgacggtggccgagagcaggctggtacctttgtcgcctacatcacccgattcaaagaggttggctccgacactctgtcccagctcatcggtaagctcaccaactgtggctgccctgtctcttgcattgtctacgaccccttcctgccctgggctgtcgaggtcggtaacaacttcggtgttgccactgctgccttcttcacccagtcttgtgccgtcgacaacatctactaccacgtccacaagggtgttctcaagctccctcccaccgacgttgacaaggagatctccatccccggtctgctcaccattgaggcttccgatgtcccctcttttgtctccaaccccgagtcctcccgaatcctcgagatgctcgtcaaccagttctccaacctcgagaacaccgactgggttctcatcaactccttctacgagctcgagaaggaagtcattgactggatggccaagatctaccccatcaagaccattggccccaccatcccctccatgtacctcgacaagcgactccccgatgacaaggagtacggtctgtccgtctttaagcccatgaccaacgcctgcctcaactggctcaaccaccagcccgtttcttccgtcgtctacgtttctttcggctctctggccaagctcgaggctgagcagatggaggagctcgcctggggtctgtccaactccaacaagaacttcctgtgggttgtccgatccactgaggagtccaagctccccaacaacttcctcgaggagctcgcctccgagaagggtctggttgtctcttggtgcccccagctccaggttctcgagcacaagtccatcggttgcttcctgacccactgcggctggaactccactctcgaggccatctctctcggtgtccccatgattgccatgccccactggtccgaccagcccaccaacgccaagctcgtcgaggatgtctgggagatgggtatccgacccaagcaggatgagaagggtctggtccgacgagaggtcattgaggagtgtatcaagattgtcatggaggagaagaagggcaagaagatccgagagaacgccaagaagtggaaggagctcgcccgaaaggctgttgacgagggtggctcttccgaccgaaacattgaggagttcgtttccaagctcgtcaccatcgcttccgtcgaatcg

SEQ ID NO: 173 - DNA, 1434 bp, Vaccaria hispanica
atgtccaacaacgagaacaacgccacccaggtcattgttctgccctaccacggccagggccacatgaacaccatggtccagtttgccaagcgactcgcctggaagggtgtccacgtcaccatcgccaccaccttcaacaccatccagcagatgaagctcaacatctcctcttacaactccatcactctcgagcccatctacgacgacaccgacgactccactctgcacatcaaggaccgaatggcccgattcgaggctgaggctgcctccaacctgacccgagttctcgaggccaagaagcagcagcaggctctcaacaagaagtgtctgctcgtctaccacggctctctcaactgggccctcgttgtcgcccaccagcagaacgttgccggtgctgccttcttcaccgccgcctctgcttctttcgcctgctactactacctgcacctcgagtcccagggcaagggtgtcgatctcgaggagctcccctccattctgccccctcccaaggtcatcgtccagaagctccccaagtccttcctggcctacggtgacaacaactcccacaacaacaacaataacaacaataacaacaacaataacaacaacatgggtctgcaccctctggttctgtggctcctcaaggactacggcaactccgtcaaggccgactttgtcctcctcaactccttcgacaagctcgaggaagaggccatcaagtggatctccaacatctgctccgtcaagaccatcggtcccaccatcccctccacctacctcgacaagcagatcgagaacgatgtcgactacggtttcaaccagtacaagcccaccaacgaggactgcatgaagtggctcgacaccaaggaagccaactccgttgtctacattgccttcggctctgttgctcgactgtccgtcgagcagatggccgagattgccaaggctctcgaccactcctccaagtctttcatctgggttgtccgagagactgagaaggagaagctccccgtcgacctcgtcgagaagatctccggccagggtatggttgtcccctgggctccccagctcgaggtcctcgcccacgatgctgtcggctgtttcgtttcccactgtggctggaactccaccattgaggctctgtctttcggtgtccccatcctcgccatgccccagttcctcgaccagctcgttgatgcccactttgtcgaccgagtctggggtgtcggtattgcccccactgtcgacgagaacgatctcgtcacccaggaagagatctcccgatgcctcgacgagatgatgggtggtggtcccgagggtgagaagatcaagaagaacgttgccatgtggaaggagctgaccaaagaggctctcgacaagggtggctcttccgacaagcacattgacgagatcattgagtggctctcttctagt

SEQ ID NO: 174 - DNA, 1443 bp, Streptococcus mutans
atgcccatcatcaacaagaccatgctcatcacctacgccgactctctcggcaagaacctcaaggagctcaacgagaacattgagaactacttcggtgatgctgttggtggtgtccacctgctccccttcttcccctccactggtgaccgaggcttcgcccccattgactaccacgaggttgactctgccttcggtgactgggatgatgtcaagtgcctcggtgagaagtactacctcatgttcgacttcatgatcaaccacatctcccgacagtccaagtactacaaggactaccaggagaagcacgaggcttctgcctacaaggacctcttcctcaactgggacaagttctggcccaagaaccgacctacccaggaagatgtcgatctcatctacaagcgaaaggaccgagctcccaagcaggagatccagtttgccgacggctccgtcgagcacctgtggaacaccttcggtgaggagcagattgacctcgatgtcaccaaggaagtcaccatggacttcatccgatccaccattgagaacctggctgccaacggctgtgacctcatccgactcgacgcctttgcctacgccgtcaagaagctcgacaccaacgacttcttcgtcgagcccgagatctggactctgctcgacaaggtccgagacattgctgccgtttccggtgccgagatcctccccgagatccacgagcactacaccatccagttcaagattgctgaccacgactactacgtctacgactttgctctgcccatggtcactctgtactctctgtactcctccaaggtcgaccgactcgccaagtggctcaagatgtctcccatgaagcagttcaccaccctcgacacccacgacggtatcggtgttgttgatgtcaaggacattctgaccgacgaggagatcacctacacctccaacgagctctacaaggtcggtgccaacgtcaaccgaaagtactccactgccgagtacaacaacctcgatatctaccagatcaactccacctactactctgctctcggtgacgacgaccagaagtacttcctggcccgactcatccaggcctttgcccccggtatcccccaggtctactacgttggcttcctcgccggcaagaacgatctcgagctgctcgagtccaccaaagagggccgaaacatcaaccgacactactactcctccgaggagattgctaaagaggtcaagcgacccgttgtcaaggctctgctcaacctcttcacctaccgaaaccagtccgccgcctttgacctcgacggccgaatcgaggttgagactcccaacgaggccaccattgtcatcgagcgacagaacaaggacggctctcacattgccaaggccgagatcaacctgcaggacatgacctaccgagtcaccgagaacgaccagaccatctccttcgag

SEQ ID NO: 175 - DNA, 1392 bp, Lobelia erinus
atggacaacaaccacctcggtgagactctgctccccctcgctcccaagaacggccgacgagttctcttcttcccctaccccctccagggccacatctcccccatgctcaacctcgccaacctgctccactccaagggtttcaccatcaccatcatccacaccaacctcaactcccccaaccagtccgactacccccacttcaccttccgaccctttgacgacggtttccctccttactccaagggctggcagctcgccaccctctgctcccgatgtgtcgagcccttccgagagtgtctggcccagatcttcctgtccgaccacaccgcccccgagggtgagcgagagtccattgcctgcctcattgccgatggtctgtggaacttcctcggtgctgccgtctacaacttcaagctccccatgattgttctgcgaaccggtaacatgtccaacattgttgccaacgtcaagctcccctgcttcatcgagaagggctactttgaccacaccaaggaaggctccaagctcgaggctgccgtccccgagttccccaccatcaagttcaaggacattctcaagacctacggctccaaccccaaggccatctgtgagactctgaccgctctgctcaaggagatgcgagcttcttccggtgtcatctggaactcctgcaaggagctcgagcagtccgagctccagatgatctgcaaggagttccccgtcccccacttcctcatcggtcctctgcacaagtacttccccgcctcttcttcttctctcgttgcccacgacccctcttccatctcttggctcaactccaaggctcccaactccgtcctctacgtttcttttggctccatctcctccatggacgaggctgagttcctcgagactgcctggggtctggccaactccatgcagcagttcctgtgggttgtccgacccggctccgtccgaggttcccagtggctcgagtctctgcccgatggtttcattgacaagctcgacggccgaggccacattgtcaagtgggctccccagcaagaggttctcgcccaccaggccaccggtggtttctggacccactgtggctggaactccactctcgagtccatgtgcgagggtgtccccatgatctgctcccacggtatcatggaccagcccatcaacgcccgatacgtcaccgatgtctggaaggtcggtatcgagctcgagaagggctttgactccgaggagatcaagatggccatccgacgactcatggtcgataaagagggccaggagatccgagagcgatcttctcgactcaaggagtctctgtccaactgtctcaagcagggtggttcctcccacgactccgtcgagtctctggtcgaccacattctcagcttc

SEQ ID NO: 176 - DNA, 1380 bp, Arabidopsis thaliana
atggaggagcgaaagggccgacgaatcatcatgttccctctgcccttccccggccacttcaaccccatgatcgagctcgctggtatcttccaccaccgaggcttctccgtcaccatcctccacacctcctacaacttccccgacccctctcgacacccccacttcaccttccgaaccatctcccacaacaaggaaggcgaagaggaccccctgtcccagtccgagacttcttccatggacctcattgttctcgtccgacgactcaagcagcgatacgctgagcccttccgaaagtccgttgctgctgaggtcggtggtggtgagactgtctgctgcctcgtttccgatgccatctggggtaagaacaccgaggttgttgccgaggagattggtgtccgacgagttgtcctccgaaccggtggtgcctcttctttctgcgcctttgctgctttccctctgctccgagacaagggctacctccccatccaggactcccgactcgacgagcccgtcaccgagctgccccctctcaaggtcaaggatctgcccgtcatggagactaacgagcccgaggagctctaccgagttgtcaacgacatggtcgagggtgccaagtcctcttccggtgtcatctggaacacctttgaggatctcgagcgactctctctcatgaactgctcctccaagctccaggtccccttcttccccatcggtcccttccacaagtactccgaggaccccacccccaagaccgagaacaaggaagataccgactggctcgacaagcaggacccccagtccgttgtctacgcctcttttggctctctcgccgccatcgaggagaaggagttcctcgagattgcctggggtctgcgaaactccgagcgacccttcctgtgggttgtccgacccggctccgtccgaggcaccgagtggctcgagtctctgcccctcggcttcatggagaacattggtgacaagggcaagatcgtcaagtgggccaaccagctcgaggttctggcccaccccgccatcggtgccttctggacccactgtggctggaactccactctcgagtccatctgtgagggtgtccccatgatctgcacctcttgtttcaccgaccagcacgtcaacgcccgatacattgtcgatgtctggcgagtcggtatgctgctcgagcgatccaagatggagaagaaggagattgagaaggtcctccgatccgtcatgatggagaagggtgacggtctgcgagagcgatctctcaagctcaaggagcgagccgacttctgcctctccaaggacggctcctcctccaagtacctcgacaagcttgtctcccacgttctgtcttttgactcctacgcctttgcatcc

SEQ ID NO: 177 - DNA, 2139 bp, Gibberella fujikuroi
atggctgagctcgacactctcgacattgttgttctcggtgtcatcttcctcggtaccgttgcctacttcaccaagggtaagctgtggggtgtcaccaaggacccctacgccaacggctttgctgctggtggtgcctccaagcccggccgaacccgaaacattgttgaggccatggaggagtccggcaagaactgtgttgttttctacggctcccagaccggcaccgccgaggactacgcctctcgactggccaaggaaggcaagtctcgattcggtctgaacaccatgatcgctgatctcgaggactacgactttgacaacctggacaccgtcccctccgacaacatcgtcatgtttgtcctggccacctacggtgagggtgagcccaccgacaacgccgtcgacttctacgagttcatcaccggtgaggacgcttctttcaacgagggtaacgaccctcctctcggcaacctcaactacgttgccttcggtctgggcaacaacacctacgagcactacaactccatggtccgaaacgtcaacaaggctctcgagaagctcggcgcccaccgaatcggtgaggctggtgagggtgacgacggtgccggtaccatggaggaagatttcctggcctggaaggaccccatgtgggaggctctcgccaagaagatgggcctcgaggagcgagaggccgtctacgagcccatctttgccatcaacgagcgagatgatctcacccccgaggccaacgaggtctacctcggtgagcccaacaagctccacctcgagggtaccgccaagggccccttcaactcccacaacccctacattgcccccattgctgagtcctacgagctgttctccgccaaggaccgaaactgtctgcacatggagattgacatctccggctccaacctcaagtacgagactggtgaccacatcgccatctggcccaccaaccccggtgaagaggtcaacaagttcctcgacatcctcgatctctccggcaagcagcactctgttgtcaccgtcaaggctctcgagcccaccgccaaggtccccttccccaaccccaccacctacgacgccatcctgcgataccacctcgagatctgtgcccccgtttctcgacagttcgtttccactctggctgcctttgcccccaacgacgacatcaaggccgagatgaaccgactcggctccgacaaggactacttccacgagaaaaccggtcctcactactacaacattgctcgattcctggcttctgtctccaagggtgagaagtggaccaagatccccttctccgccttcattgagggtctgaccaagctccagccccgatactactccatctcttcttcttctctcgtccagcccaagaagatctccatcaccgctgttgtcgagtcccagcagatccccggccgagatgaccccttccgaggtgttgccaccaactacctcttcgccctcaagcagaagcagaacggtgaccccaaccccgctcccttcggtcagtcttacgagctcaccggcccccgaaacaagtacgacggtatccacgtccccgtccacgtccgacactccaacttcaagctcccctccgaccccggcaagcccatcatcatgattggccccggtactggtgttgctcccttccgaggctttgtccaggagcgagccaagcaggctcgagatggtgtcgaggtcggtaagactctgctcttcttcggctgccgaaagtccaccgaggacttcatgtaccagaaggagtggcaggagtacaaagaggctctcggtgacaagttcgagatgatcaccgccttctcccgagagggctccaagaaggtctacgtccagcaccgactcaaggagcgatccaaggaagtctccgacctcctctcccagaaggcctacttctacgtctgcggtgacgccgcccacatggcccgagaggtcaacaccgttctggcccagatcattgccgagggccgaggtgtctccgaggccaagggcgaggagattgtcaagaacatgcgatctgccaaccagtaccaggtctgctccgactttgtcaccctccactgcaaggagactacttacgccaactccgagctccaggaagatgtctggtct

SEQ ID NO: 178 - DNA, 2076 bp, Arabidopsis thaliana
atgacctctgctctctacgcctccgatctcttcaagcagctcaagtccatcatgggtaccgactccctgtccgacgatgtcgttctggtcattgccaccacctctctggctctggtcgccggtttcgttgtcctcctctggaagaaaaccaccgctgaccgatccggcgagctcaagcccctcatgatccccaagtctctcatggccaaggacgaggacgacgatctcgatctcggttccggcaagacccgagtctccatcttctttggcacccagaccggtaccgccgagggtttcgccaaggctctctccgaggagatcaaggcccgatacgagaaggccgccgtcaaggtcatcgacctcgacgactacgctgctgacgacgaccagtacgaggagaagctcaagaaggagactctcgccttcttctgtgtcgccacctacggtgacggcgagcccaccgacaacgccgcccgattctacaagtggttcaccgaggagaacgagcgagacatcaagctccagcagctggcctacggtgttttcgccctcggcaaccgacagtacgagcacttcaacaagatcggtattgtcctcgacgaggagctctgcaagaagggtgccaagcgactcattgaggttggtctgggtgatgatgaccagtccattgaggacgacttcaacgcctggaaggagtctctgtggtccgagctcgacaagctgctcaaggacgaggacgacaagtccgttgccaccccctacaccgccgtcatccccgagtaccgagtcgtcacccacgacccccgattcaccacccagaagtccatggagtccaacgttgccaacggtaacaccaccattgacatccaccacccctgccgagtcgacgttgccgtccagaaggagctccacacccacgagtccgaccgatcttgtatccacctcgagtttgacatctcccgaaccggtatcacctacgagactggtgaccacgttggtgtctacgccgagaaccacgttgagattgtcgaggaagctggtaagctgctcggccactctctcgacctcgttttctccatccacgccgacaaagaggacggctctcccctcgagtccgctgttccccctcccttccccggcccctgcactctcggcaccggtctggcccgatacgctgacctcctcaaccctccccgaaagtccgctctggttgctctcgccgcctacgccaccgagccctccgaggccgagaagctcaagcacctgacctcccccgacggcaaggacgagtactcccagtggatcgttgcttcccagcgatctctgctcgaggtcatggccgccttcccctctgccaagccccctctgggtgttttctttgccgccattgctccccgactccagccccgatactactccatctcctcctctccccgactcgccccctctcgagtccacgtcacctctgctctcgtctacggtcccactcccactggccgaatccacaagggtgtctgctccacctggatgaagaacgccgtccccgctgagaagtcccacgagtgctccggtgctcccatcttcatccgagcctccaacttcaagctcccctccaacccctccacccccattgtcatggtcggccccggtactggtctggcccccttccgaggcttcctccaggagcgaatggctctcaaggaagatggtgaggagctcggctcttctctgctcttctttggctgccgaaaccgacagatggacttcatctacgaggacgagctcaacaactttgtcgaccagggtgtcatctccgagctcatcatggccttctcccgagagggtgcccagaaggagtacgtccagcacaagatgatggagaaggccgcccaggtctgggatctcatcaaggaagagggctacctctacgtctgtggtgacgccaagggcatggcccgagatgtccaccgaactctgcacaccattgtccaggagcaggaaggtgtctcttcctccgaggctgaggccattgtcaagaagctgcagaccgagggccgatacctgcgagatgtatgg

SEQ ID NO: 179 - DNA, 2133 bp, Arabidopsis thaliana
atgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctgg

SEQ ID NO: 180 - DNA, 1575 bp, Gibberella fujikuroi
atgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgag

SEQ ID NO: 181 - DNA, 1419 bp, Stevia rebaudiana
atggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagt

SEQ ID NO: 182 - DNA, 2552 bp, Artificial sequence
  tCPS-cwpT
cccactagttataaagtcacaagtatctcagtatacccgtctaaccacacatttatcaccatgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatttaagttttttgatcaatgatccaatggctttcacatacccccccacgcctataattaaaacacagagaaatataatctaacttaataaatattacggagaatctttcgagtgttcagcagaaatatagccattgtaacaaaagccggctatcgaccgctttatcgaagaatatttcccgccccccagtggccaaacgatatcgaaacaaaagagctgaaatcatatccttcagtagtagtatagtcctgttatcacagcatca

SEQ ID NO: 183 - DNA, 2394 bp, Artificial sequence
  tKS
agatatacaagcaatgtcactctccttcgtactcgtacatacaacacaactacattcaaaatgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagaggtaactatccgaagatcaagagcgaagcaagttgtaagtccaggacatgtttcccgcccacgcg

SEQ ID NO: 184 - DNA, 2979 bp, Artificial sequence
  CPSKS
cccactagttataaagtcacaagtatctcagtatacccgtctaaccacacatttatcaccatgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaataactatccgaagatcaagagcgaagcaagttgtaagtccaggacatgtttcccgcccacgcg

SEQ ID NO: 185 - DNA, 1698 bp, Artificial sequence
  KAH4
ttgaatcttttttcttcttctcttctctatattcattcttgaattaaacacacatcaacaatggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgtataaacttcgagctaatccagtagcttacgttacccaggggcaggtcaactggctagccacgag

SEQ ID NO: 186 - DNA, 1698 bp, Artificial sequence
  KOgib
cacacccgaaatcgttaagcatttccttctgagtataagaatcattcgctagccacaaaaatgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgagtaagctatttacagcatgtgtaatgaggaatataacgttgattgaattgtttgtgaaaaatgt

SEQ ID NO: 187 - DNA, 2262 bp, Artificial sequence
  CPR1
cgtccatatatatctatgctgcgtcgtccttttcgtgacatcaccaaaacacatacaaaaatggctgagctcgacactctcgacattgttgttctcggtgtcatcttcctcggtaccgttgcctacttcaccaagggtaagctgtggggtgtcaccaaggacccctacgccaacggctttgctgctggtggtgcctccaagcccggccgaacccgaaacattgttgaggccatggaggagtccggcaagaactgtgttgttttctacggctcccagaccggcaccgccgaggactacgcctctcgactggccaaggaaggcaagtctcgattcggtctgaacaccatgatcgctgatctcgaggactacgactttgacaacctggacaccgtcccctccgacaacatcgtcatgtttgtcctggccacctacggtgagggtgagcccaccgacaacgccgtcgacttctacgagttcatcaccggtgaggacgcttctttcaacgagggtaacgaccctcctctcggcaacctcaactacgttgccttcggtctgggcaacaacacctacgagcactacaactccatggtccgaaacgtcaacaaggctctcgagaagctcggcgcccaccgaatcggtgaggctggtgagggtgacgacggtgccggtaccatggaggaagatttcctggcctggaaggaccccatgtgggaggctctcgccaagaagatgggcctcgaggagcgagaggccgtctacgagcccatctttgccatcaacgagcgagatgatctcacccccgaggccaacgaggtctacctcggtgagcccaacaagctccacctcgagggtaccgccaagggccccttcaactcccacaacccctacattgcccccattgctgagtcctacgagctgttctccgccaaggaccgaaactgtctgcacatggagattgacatctccggctccaacctcaagtacgagactggtgaccacatcgccatctggcccaccaaccccggtgaagaggtcaacaagttcctcgacatcctcgatctctccggcaagcagcactctgttgtcaccgtcaaggctctcgagcccaccgccaaggtccccttccccaaccccaccacctacgacgccatcctgcgataccacctcgagatctgtgcccccgtttctcgacagttcgtttccactctggctgcctttgcccccaacgacgacatcaaggccgagatgaaccgactcggctccgacaaggactacttccacgagaaaaccggtcctcactactacaacattgctcgattcctggcttctgtctccaagggtgagaagtggaccaagatccccttctccgccttcattgagggtctgaccaagctccagccccgatactactccatctcttcttcttctctcgtccagcccaagaagatctccatcaccgctgttgtcgagtcccagcagatccccggccgagatgaccccttccgaggtgttgccaccaactacctcttcgccctcaagcagaagcagaacggtgaccccaaccccgctcccttcggtcagtcttacgagctcaccggcccccgaaacaagtacgacggtatccacgtccccgtccacgtccgacactccaacttcaagctcccctccgaccccggcaagcccatcatcatgattggccccggtactggtgttgctcccttccgaggctttgtccaggagcgagccaagcaggctcgagatggtgtcgaggtcggtaagactctgctcttcttcggctgccgaaagtccaccgaggacttcatgtaccagaaggagtggcaggagtacaaagaggctctcggtgacaagttcgagatgatcaccgccttctcccgagagggctccaagaaggtctacgtccagcaccgactcaaggagcgatccaaggaagtctccgacctcctctcccagaaggcctacttctacgtctgcggtgacgccgcccacatggcccgagaggtcaacaccgttctggcccagatcattgccgagggccgaggtgtctccgaggccaagggcgaggagattgtcaagaacatgcgatctgccaaccagtaccaggtctgctccgactttgtcaccctccactgcaaggagactacttacgccaactccgagctccaggaagatgtctggtcttaaaattaacagatagtttgccggtgataattctcttaacctcccacactcctttgacataac

SEQ ID NO: 188 - DNA, 2256 bp, Artificial sequence
  CPR3
cgtccatatatatctatgctgcgtcgtccttttcgtgacatcaccaaaacacatacaaaaatgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctggtaaaattaacagatagtttgccggtgataattctcttaacctcccacactcctttgacataac

SEQ ID NO: 189 - DNA, 1566 bp, Artificial sequence
  UGT1
cccactagttataaagtcacaagtatctcagtatacccgtctaaccacacatttatcaccatggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaactaactatccgaagatcaagagcgaagcaagttgtaagtccaggacatgtttcccgcccacgcg

SEQ ID NO: 190 - DNA, 1503 bp, Artificial sequence
  UGT3
ttgaatcttttttcttcttctcttctctatattcattcttgaattaaacacacatcaacaatggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcctaaacttcgagctaatccagtagcttacgttacccaggggcaggtcaactggctagccacgag

SEQ ID NO: 191 - DNA, 1497 bp, Artificial sequence
  UGT4
cacacccgaaatcgttaagcatttccttctgagtataagaatcattcgctagccacaaaaatggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttgtaagctatttacagcatgtgtaatgaggaatataacgttgattgaattgtttgtgaaaaatgt

SEQ ID NO: 192 - DNA, 1542 bp, Artificial sequence
  UGT9
cgtccatatatatctatgctgcgtcgtccttttcgtgacatcaccaaaacacatacaaaaatggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagttaaaattaacagatagtttgccggtgataattctcttaacctcccacactcctttgacataac

SEQ ID NO: 193 - DNA, 880 bp, Artificial sequence
  pTPI
aaacaaaagagctgaaatcatatccttcagtagtagtatagtcctgttatcacagcatcaattacccccgtccaagtaagttgattgggatttttgtttacagatacagtaatatacttgactatttctttacaggtgactcagaaagtgcatgttggaaatgagccacagaccaagacaagatatgacaaaattgcactattcgatgcagaattcgacggtgtttccattggtgttatgacattcatctgcattcatacaaaaaagtcttggtagtggtacttttgcgttattacctccgatatctacgcaccccccaacccccctgctacagtaaagagtgtgagtctactgtacatgcttactaaaccacctactgtacagcgaaacccctcagcaaaatcacacaatcagctcattacaacacacccaatgacctcaccacaaattctatacgccttttgacgccattattacagtagcttgcaacgccgttgtcttaggttccatttttagtgctctattacctcacttaacccgtataggcagatcaggccatggcactaagtgtagagctagaggttgatatcgccacgagtgctccatcagggctagggtggggttagaaatacagtccgtgcgcactcaaaaggcgtccgggttagggcatccgataatatcgcctggactcggcgccatattctcgacttctgggcgcgttgtattcatctcctccgcttcccaacacttccacccgtttctccatcccaaccaatagaatagggtaaccttattcgggacactttcgtcatacatagtcagatatacaagcaatgtcactctccttcgtactcgtacatacaacacaactacattcaaa

SEQ ID NO: 194 - DNA, 1183 bp, Artificial sequence
  gpdT-pGPD
ctatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtatggcgcgccggtagtcggaaagagccgggaccggccggcgagcataaaccggacgcagtaggatgtcctgcacgggtctttttgtggggtgtggagaaaggggtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaca

SEQ ID NO: 195 - DNA, 639 bp, Artificial sequence
  pgmT-pTEF
acttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctggcgtacgccggcgaagcttggtaccagagacgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcgctagccacaaaa

SEQ ID NO: 196 - DNA, 1009 bp, Artificial sequence
  pgkT-pPGM
gctatttacagcatgtgtaatgaggaatataacgttgattgaattgtttgtgaaaaatgtagaaaatttcagtgaagttgtgttttctatatagtaagcacttttggtacaagtatctgcacatccctgcatgttacaagcctgatcatgcagggcaatattctgactataaatatacctcgatattttagcaagctatacgtacgtaccaaccacagattacgacccattcgcagtcacagttcactagggtttgggttgcatccgttgagagtggtttgtttttaaccttctccatgtgctcactcaggttttgggttcagatcaaatcaaggcgtgaaccactgtttgaggacaaatgtgacacaaccaaccagtgtcaggggcaagtccgtgacaaaggggaagatacaatgcaattactgacagttacggactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggtggaacgagcttagtcttcaattgaggtgcgagcgacacaattgggtgtcacgtggcctaattgacctcggatcgtggagtccccagttatacagcaaccacgaggtgcatgagtaggagacgtcaccagacaatagggtttttttggactggagagggtagggcaaaagcgctcaacgggctgtttggggagctatgggggaggaattggcgatatttgtgaggttgacggctccgatttgcgtgttttgtcgcttctgcatctccccatacccatatcttccctccccacctctttccacgataattttacggatcagcaataaggttccttctcctagtttccacgtccatatatatctatgctgcgtcgtccttttcgtgacatcaccaaaacacatacaaaa

SEQ ID NO: 197 - DNA, 2472 bp, Artificial sequence
  LEU2 and flanking sequences
aaaattaacagatagtttgccggtgataattctcttaacctcccacactcctttgacataacgatttatgtaacgaaactgaaatttgaccagatattgttgtaaatagaaaatctggcttgtaggtggaaactagtaacggccgccagtgtgctggaattcggctccactgtcctccactacaaacacacccaatctgcttcttctagtcaaggttgctacaccggtaaattataaatcatcatttcattagcagggctgggccctttttatagagtcttatacactagcggaccctgccggtagaccaacccgcaggcgcgtcagtttgctccttccatcaatgcgtcgtagaaacgacttactccttcttgagcagctccttgaccttgttggcaacaaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtggactcttcccatcaccaataaagactcatactacaatcacgagcgcttcagctgccactatagtgttggtgacacaatacccctcgatgctgggcattactgtagcaagagatattatttcatggcgcatttttccagtctacctgactttttagtgtgatttcttctccacattttatgctcagtgtgaaaagttggagtgcacacttaattatcgccggttttcggaaagtactatgtgctcaaggttgcaccccacgttacgtatgcagcacattgagcagcctttggaccgtggagataacggtgtggagatagcaacgggtagtcttcgtaataagcaatgcagccgaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgca

SEQ ID NO: 198 - DNA, 6989 bp, Artificial sequence
  Vector sequences
ctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaccccccccccgcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcaggtgggccattctcatgaagaatatcttgaatttattgtcatattactagttggtgtggaagtccatatatcggtgatcaatatagtggttgacatgctggctagtcaacattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcactttagcatacatatattacacgagccagaaattgtaacttttgcctaaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctaggagcggccaaaatgccgaggctttcatagcttaaactctttacagaaaataggcattatagatcagttcgagttttcttattcttccttccggttttatcgtcacagttttacagtaaataagtatcacctcttagagttaactatgagataagcaagtatcatctcatttcatttacctgaagtcgagtaaacagaaaatccaattgttgatgaacctcaatgacttagaactatctatcggcagatcatataaagaggatttaggtacctagaggactgtacctggagtatatatatatatatatatatattatctcaactatagtccatagaggtttctttcttgaggccttaaactgctaaagaatgatattggtggaatgcaagcaccaatctctcttctttcgtaactgttcatatacttcaaaccaagaatgtaacgggcattgacccatccaaaaccttcagtagctgcccctttaaagtcagcaccttgattaccgtattctgcttcaacacgatgaggatctgttcctcttgtgacatcatatttttcaaccacaataccattataatcgacaaaagcctttgtcatcatgaaaagccatctataagctagcctattcgttacagttaaataaccataagaacggaggccttcccaagcaagaatttgatggggtgcccaaccaaatggatagtcccattgtctaattggtctcgaaatagaaattgggcctcgagaacgctccgtacatgcagctaaacctccaagcatctctaacttgggtagtgctttctccaccattttctgtgcttgctccttcgtggcaagtccagcccataatgcccagaatgtagttgcggattcgtatgacgttctgtgcttgatttttgtgttgtagtcaaagaaaaaccccgactcgtcatcccacatatatttggtaattgatgaggcaacgctaattatcaacatatagattgttatctatctgcatgaacacgaaatctttacttgacgacttgaggctgatggtgtttatgcaaagaaaccactgtgtttaatatgtgtcactgtttgatattactgtcagcgtagaagataatagtaaaagcggttaataagtgtatttgagataagtgtgataaagtttttacagcgaaaagacgataaatacaagaaaatgattacgaggatacggagagaggtatgtacatgtgtatttatatactaagctgccggcggttgtttgcaagaccgagaaaaggctagcaagaatcgggtcattgtagcgtatgcgcctgtgaacattctcttcaacaagtttgattccattgcggtgaaatggtaaaagtcaaccccctgcgatgtatattttcctgtacaatcaatcaaaaagccaaatgatttagcattatctttacatcttgttattttacagattttatgtttagatcttttatgcttgcttttcaaaaggcctgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggtttccgcgcacatttccccgaaaagtgccacctgacgtctaagaaaccattattatcatgacattaacctataaaaataggcgtatcacgaggccctttcgtcttggccacctaggccggccttcccggaagtatatactaattcattccttgaatatttatgaaaagcaacatgtgtatttcttgtgtgtgcggcaaacgtagcaattgcaactgcataaacgatgattgtaaaagtatcacactttgctcagacaggttagattcacctggtacgagggcagtgtcttaaaggttccatctacctcggcccttgtttcttgaagagtggtcaatatgtgttttatacagctgaaatttcccctgtatgttgagatcgtgtatattggtcataatctgggctctttagtcgatcccagttttctcgggcaagtttttttctccacaaagtaccgctggaaaactctatgtgacttgttgacagattacttgggttatctgcgggatatgtcttggataggcaaccgggcatatatcaccgggcggactgttggttctgtac

SEQ ID NO: 199 - DNA, 1170 bp, Artificial sequence
  pENO
tcgggcaagtttttttctccacaaagtaccgctggaaaactctatgtgacttgttgacagattacttgggttatctgcgggatatgtcttggataggcaaccgggcatatatcaccgggcggactgttggttctgtacgtacatacagcactttgagctcatgtctcacacgcaaccatggtgcgtggaggctttggcatcctttctacttgtagtggctatagtacttgcagtccaagcaaacatgagtatgtgcttgtatgtactgaaacccgtctacggtaatattttagagtgtggaactatgggatgagtgctcattcgatactatgttgtcacccgatttgccgtttgcgaggtaagacacattcggtggttcaggcggctacttgtatgtagcatccacgttcatgttttgtggatcagattaatggtatggatatgcacggggcgtttccccggtaacgtgtaggcagtccagtgcaacccagacagctgagctctctatagccgtgcgtgtgcggtcatatcacgctacacttagctacagaataaagctcggtagcgccaacagcgttgacaaatagctcaagggcgtggagcacagggtttaggaggttttaatgggcgagaaggcgcgtagatgtagtcttcctcggtcccatcggtaatcacgtgtgtgccgatttgcaagacgaaaagccacgagaataaaccgggagaggggatggaagtccccgaacagcaaccagcccttgccctcgtggacataacctttcacttgccagaactctaagcgtcaccacggtatacaagcgcacgtagaagattgtggaagtcgtgttggagactgttgatttgggcggtggaggggggtatttgagagcaagtttgagatttgtgccattgagggggaggttattgtggccatgcagtcggatttgccgtcacgggaccgcaacatgcttttcattgcagtccttcaactatccatctcacctcccccaatggcttttaactttcgaatgacgaaagcacccccctttgtacagatgactatttgggaccaatccaatagcgcaattgggtttgcatcatgtataaaaggagcaatcccccactagttataaagtcacaagtatctcagtatacccgtctaaccacacattt

SEQ ID NO: 200 - DNA, 2276 bp, Artificial sequence
  HPH
aaattaacagatagtttgccggtgataattctcttaacctcccacactcctttgacataacgatttatgtaacgaaactgaaatttgaccagatattgttgtaaatagaaaatctggcttgtaggtggcaaactagtaacggccgccagtgtgctggaattgaatatttaccgttcgtataatgtatgctatacgaagttataccggtctcgtagtgttcacgttcagttcacggtgagcttaaaactatcttcaagaagagatttgagacctgatttatacttgcagcaatgtttacttcttatcgcgatacacgaatgtgatacggatcaaagtaagcaggactacgataagataacgaatgcggtgcagtccatgtcgattaggtatagatacatttattttgtgttatgttacattttggggggatactgtcctacttgtagtacctacttgtagtggcgcgtctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatgggtacctgagaacatttttgtgtctaggtgtttgtgtttggactgcgatcagtgaagaaaagaagaggaaaaattgtgcaagaaattttgctttcaagacttggctgatgcagcagggtaactctgggacacagacctatgtttgtggttaaactcaatgcacgtggtacgtgcgtggagcgcttacccatccaagggtgtggacatggaaccgacggtccgtggagttgtgtaatgtcattttggcgactcttgaagcaaggctataaaaaaattgtgtggcttgagtcttatcgagctcggtcactacaagagttaatcttcctgtctcaggcagacaggtcaggcagggttacttttgggtgtgctgtaactcactgtatggccgttagtgcgcatagacgttgtacatactggaccgaattgtagcgtgctcaatagggccaataaagctattgtagggatccataacttcgtataatgtatgctatacgaacggtacccgggcaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgca

SEQ ID NO: 201 - DNA, 600 bp, Artificial sequence
  Sc Eno2.promoter
gtgtcgacgctgcgggtatagaaagggttctttactctatagtacctcctcgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 202 - DNA, 600 bp, Artificial sequence
  Sc Fba1.promoter
ctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaa

SEQ ID NO: 203 - DNA, 600 bp, Artificial sequence
  Sc Tef1.promoter
ttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagacaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 204 - DNA, 600 bp, Artificial Sequence
  Sc Pgk1.promoter
gggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 205 - DNA, 1001 bp, Artificial sequence
  Kl prom 12.pro
cgtaaaaactaaaacgagcccccaccaaagaacaaaaaagaaggtgctgggcccccactttcttcccttgcacgtgataggaagatggctacagaaacaagaagatggaaatcgaaggaaagagggagactggaagctgtaaaaactgaaatgaaaaaaaaaaaaaaaaaaaaaaaacaagaagctgaaaatggaagactgaaatttgaaaaatggtaaaaaaaaaaaagaaacacgaagctaaaaacctggattccattttgagaagaagcaagaaaggtaagtatggtaacgaccgtacaggcaagcgcgaaggcaaatggaaaagctggagtccggaagataatcatttcatcttcttttgttagaacagaacagtggatgtccctcatctcggtaacgtattgtccatgccctagaactctctgtccctaaaaagaggacaaaaacccaatggtttccccagcttccagtggagccaccgatcccactggaaaccactggacaggaagagaaaatcacggacttcctctattgaaggataattcaacactttcaccagatcccaaatgtcccgcccctattcccgtgttccatcacgtaccataacttaccatttcatcacgttctctatggcacactggtactgcttcgactgctttgcttcatcttctctatgggccaatgagctaatgagcacaatgtgctgcgaaataaagggatatctaatttatattattacattataatatgtactagtgtggttattggtaattgtacttaattttgatatataaagggtggatctttttcattttgaatcagaattggaattgcaacttgtctcttgtcactattacttaatagtaattatatttcttattaaccttttttttaagtcaaaacaccaaggacaagaactactcttcaaaggtatttcaagttatcatacgtgtcacacacgcttcacagtttcaagtaaaaaaaaagaatattacaca

SEQ ID NO: 206 - DNA, 403 bp, Artificial sequence
  Ag lox_TEF1.promoter
taccgttcgtataatgtatgctatacgaagttatgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaca

SEQ ID NO: 207 - DNA, 1000 bp, Artificial sequence
  Kl prom 6.pro
caaagggggggcagggacagggatacgacaagggctggggaaaaaaaaaaagatagatacgattggccgggtaagcctggggaaatgtagcaagtgcgggtaagttaaaaggtaaccacgtgactccggaagagtcacgtggttacggacttttttctctagatctcagctttttatcggtcttaccctgccctcctgccccctgccccttccctttgccccaaaaagaaaggaaatctgttggatttcgctcaggccatccctttcgttaatatcggttatcgctttacacactgcacatccttctgtccaaaaggaatccagaagtttagcttttccttcctttcccacagacattagcctaggccctctctcatcatttgcatgcctcagccaatgtaccaagaataacgcaacgaggttgggaaattttaacccaacaatcgatgcagatgtgacaagagattagacacgttccagataccagattacacagcttgtgctagcagagtgacatatggtggtgttgtgtctcgtttagtacctgtaatcgagagtgttcaaatcagtcgatttgaacacccttactgccactgaatattgattgaataccgtttattgaaggttttatgagtgatcttctttcggtccaggacaatttgttgagctttttctatgtagagttccgtcccttttttttttttttttgctttctcgcacttactagcactatttttttttcacacactaaaacactttattttaatctatatatatatatatatatatatgtaggaatggaatcacagacatttgatactcatcctcatccttattaattcttgttttaatttgtttgacttagccaaaccaccaatctcaacccatcgtatttcaggtattgtgtgtctagtgtgtctctggtatacggaaataagtgccagaagtaaggaagaaacaaagaacaagtgtctgaatactactagcctctcttttcata

SEQ ID NO: 208 - DNA, 600 bp, Artificial sequence
  Sc Pma1.pro
ccatcatgaaaaatctctcgacaccgtttatccattgcttttttgttgtctttttccctcgttcacagaaagtctgaagaagctatagtagaactatgagctttttttgtttctgttttccttttttttttttttacctctgtggaaattgttactctcacactctttagttcgtttgtttgttttgtttattccaattatgaccggtgacgaaacgtggtcgatggtgggtaccgcttatgctcccctccattagtttcgattatataaaaaggccaaatattgtattattttcaaatgtcctatcattatcgtctaacatctaatttctcttaaattttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaaa

SEQ ID NO: 209 - DNA, 600 bp, Artificial sequence
  Sc Vps68.promoter
gatatagccgctacgactgattagtgatgtgataaagatagaagatttaagtcacagaggcgtgcatctacgattttggcgtttcacattttttacacttaaattttagtgatctagccgtgaccttggcagcagtttccaaaatcattccatgaccatgtcatgcttaagaacgttagacccagaacaagtggacctgtattctaactcttcactcttgggcaaagataatagtattatcttttaccccattttttgtatgttttttcgtttattgagtttggcgtttcctatttagaaatagtacaatccggtcaatcattcgatagtgaaatatatatatttaactaggaaaattagtaaaacctcatttaaagatcattcaccttgatatatactactattgaccttttgttaatgaccattttcgtaaaaatgaactgcgattctcttctggaatttgttaccctaccttattcactaaatcagaaataataatgtgcagcgcccctttcataaagaaggcaagtatagggcatatagttaaaggtcagaactctttatccccaactacaagatcaattagaaaatcacatcata

SEQ ID NO: 210 - DNA, 600 bp, Artificial sequence
  Sc Oye2.promoter
actacaatttagcggcttagcacaatacgcgttttcaacttcctacgctagcgatgacaaaatgtctccaagaggcggaacttgcgacggatgcatggaaatatcttacgtaatgaacttccgtaatgaacttccgtaattcaagatctcttagcatctcttgttcaatcttcagactctactaagtgttcttaccaaccattggatgctcattacaaatgaatgaatatattgcacggaacggaagcggcatgctttttccgtgtcgtgtgcttagtaaagcaaaacggagtagaatcggtaagaacttcctttttgggttggaaaatcattgccattgtttggacacctttctttttccgtattgttcgagcaccgcgtttctttttgggtacttgatgaggtagcagattcctggaacgtgctttctctcgaggtaacctgccttgttcctcctggtgactttctaaaatataaaaggaaaagcatatctctagtttcgagttttttcttcatactttatttccttatgttaaacggtccagatatagaataaatcatcatattaagctaaatatagacgataatatagtatcgata

SEQ ID NO: 211 - DNA, 810 bp, Artificial sequence
  KANMX
atgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtttggctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 212 - DNA, 301 bp, Artificial sequence
  Adh1.Terminator
agcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaa

SEQ ID NO: 213 - DNA, 301 bp, Artificial sequence
  Adh2.terminator
agcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtgtccctcgatatttctcat

SEQ ID NO: 214 - DNA, 301 bp, Artificial sequence
  Gmp1.Terminator
agtctgaagaatgaatgatttgatgatttctttttccctccatttttcttactgaatatatcaatgatatagacttgtatagtttattatttcaaattaagtagctatatatagtcaagataacgtttgtttgacacgattacattattcgtcgacatcttttttcagcctgtcgtggtagcaatttgaggagtattattaattgaataggttcattttgcgctcgcataaacagttttcgtcagggacagtatgttggaatgagtggtaattaatggtgacatgacatgttatagcaata

SEQ ID NO: 215 - DNA, 301 bp, Artificial sequence
  Sc Tal1.Terminator
aggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtc

SEQ ID NO: 216 - DNA, 301 bp, Artificial sequence
  Sc Tpi1.terminator
agattaatataattatataaaaatattatcttcttttctttatatctagtgttatgtaaaataaattgatgactacggaaagcttttttatattgtttctttttcattctgagccacttaaatttcgtgaatgttcttgtaagggacggtagatttacaagtgatacaacaaaaagcaaggcgctttttctaataaaaagaagaaaagcatttaacaattgaacacctctatatcaacgaagaatattactttgtctctaaatccttgtaaaatgtgtacgatctctatatgggttactca

SEQ ID NO: 217 - DNA, 285 bp, Artificial sequence
  Ag Tef1_lox.terminator
atcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggta

SEQ ID NO: 218 - DNA, 301 bp, Artificial sequence
  Sc Pdc1.terminator
agcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaaca

SEQ ID NO: 219 - DNA, 301 bp, Artificial sequence
  Sc Tdh1.terminator
aataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggtttaaagatttttcctttttgggaaataagtaaacaatatattgctgcctt

SEQ ID NO: 220 - DNA, 301 bp, Artificial sequence
  Sc Eno1.terminator
aagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcc

SEQ ID NO: 221 - DNA, 1000 bp, Artificial Sequence
  Kl prom 3.pro
gagcctgtccaagcaaatgccttctcataaatggtgccaaagacccgcaagcccaaagcaattaccccccaaaaagaaatgatatagtgcaagatacgtatatgaccatgacttgactaggtgaaacagtgcagaaacagccgcacaaaagcagccctaaccctcagagtcgattttactctttcaggtaataaagcctcgacatcaattttagacagaagccaggctggcctcgagattatagccataggcaagcaagaggagagaaggggaggccccccatggggggcctcccccccgctgtcaaggtttggcagaacctagcttcattaggccactagcccagcctaaaacgtcaacgggcaggaggaacactcccacaagacggcgtagtattctcgattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaa

SEQ ID NO: 222 - DNA, 1000 bp, Artificial sequence; identical to SEQ ID NO: 221
  Kl prom 2.pro

SEQ ID NO: 223 - DNA, 600 bp, Artificial sequence
  Sc PRE3.promoter
caaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctgttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgacacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaataga

The invention claimed is:

1. A method for the production of a steviol glycoside, which method comprises:
   fermenting a recombinant microorganism of the genus Yarrowia in a suitable fermentation medium at a temperature of about 29° C. or higher and below 45° C., wherein the temperature of fermentation in such method is from 32° C. to 34° C. during the steviol glycoside production phase,
   wherein the microorganism comprises one or more nucleotide sequence(s) encoding:
   a. a polypeptide having ent-copalyl pyrophosphate synthase activity, wherein said nucleotide sequence comprises:
      i. a nucleotide sequence encoding a polypeptide having ent-copalyl pyrophosphate synthase activity, said polypeptide comprising an amino acid sequence that has at least about 70% sequence identity with the amino acid sequence of SEQ ID NOs: 2, 4, 6, 8, 18, 20, 60 or 62;
      ii. a nucleotide sequence that has at least about 70% sequence identity with the nucleotide sequence of SEQ ID NOs: 141, 142, 151, 152, 153, 154, 159, 160, 182 or 184;
      iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
      iv. a nucleotide sequence which differs from the nucleotide sequence of (i), (ii) or (iii) due to the degeneracy of the genetic code;
   b. a polypeptide having ent-Kaurene synthase activity, wherein said nucleotide sequence comprises:
      i. a nucleotide sequence encoding a polypeptide having ent-Kaurene synthase activity, said polypeptide comprising an amino acid sequence that has at least about 70% sequence identity with the amino acid sequence of SEQ ID NOs: 10, 12, 14, 16, 18, 20, 64 or 66;
      ii. a nucleotide sequence that has at least about 70% sequence identity with the nucleotide sequence of SEQ ID NOs: 143, 144, 155, 156, 157, 158, 159, 160, 183 or 184;
      iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or iv. a nucleotide sequence which differs from the nucleotide sequence of (i), (ii) or (iii) due to the degeneracy of the genetic code;

c. a polypeptide having ent-Kaurene oxidase activity, wherein said nucleotide sequence comprises:

i. a nucleotide sequence encoding a polypeptide having ent-Kaurene oxidase activity, said polypeptide comprising an amino acid sequence that has at least about 70% sequence identity with the amino acid sequence of SEQ ID NOs: 22, 24, 26, 68 or 86;

ii. a nucleotide sequence that has at least about 70% sequence identity with the nucleotide sequence of SEQ ID NOs: 145, 161, 162, 163, 180 or 186;

iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or iv. a nucleotide sequence which differs from the nucleotide sequence of (i), (ii) or (iii) due to the degeneracy of the genetic code; and d. a polypeptide having kaurenoic acid 13-hydroxylase activity, wherein said nucleotide sequence comprises:

i. a nucleotide sequence encoding a polypeptide having kaurenoic acid 13-hydroxylase activity, said polypeptide comprising an amino acid sequence that has at least about 70% sequence identity with the amino acid sequence of SEQ ID NOs: 28, 30, 32, 34, 70, 90, 92, 94, 96 or 98;

ii. a nucleotide sequence that has at least about 70% sequence identity with the nucleotide sequence of SEQ ID NOs: 146, 164, 165, 166, 167 or 185;

iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or iv. a nucleotide sequence which differs from the nucleotide sequence of (i), (ii) or (iii) due to the degeneracy of the genetic code;

whereby expression of the nucleotide sequence(s) confer(s) on the microorganism the ability to produce at least steviol, and wherein the recombinant microorganism further comprises one or more nucleotide sequences encoding a polypeptide having UDP-glucosyltransferase activity, whereby expression of the further nucleotide sequence(s) confer(s) on the microorganism the ability to produce at least one of steviolmonoside, steviolbioside, stevioside or rebaudioside A, rebaudioside B, rebaudioside C, rebaudioside D, rebaudioside E, rebaudioside F, rebaudioside M, rubusoside, and dulcoside A at a concentration of above 5 mg/L in the fermentation medium; and recovering the steviol glycoside.

2. The process according to claim 1, wherein the recombinant microorganism comprises a nucleotide sequence encoding a polypeptide capable of catalyzing the addition of glucose to the C-13 position of steviol, whereby expression of the nucleotide sequence confers on the microorganism the ability to produce at least steviolmonoside.

3. The process according to claim 1, wherein the recombinant microorganism comprises a nucleotide sequence encoding a polypeptide capable of catalyzing the addition of a glucose at C-13 position of steviol or steviolmonoside, whereby expression of the nucleotide sequence confers on the microorganism the ability to produce at least steviolbioside.

4. The process according to claim 1, wherein the recombinant microorganism comprises a nucleotide sequence encoding a polypeptide capable of catalyzing the addition of glucose to the C-19 position of steviolbioside, whereby expression of the nucleotide sequence confers on the microorganism the ability to produce at least stevioside.

5. The process according to claim 1, wherein the recombinant microorganism comprises a nucleotide sequence encoding a polypeptide capable of catalyzing glucosylation of the C-3' of the glucose at the C-13 position of stevioside, whereby expression of the nucleotide sequence confers on the microorganism the ability to produce at least rebaudioside A.

6. The process according to claim 1, wherein the recombinant microorganism comprises a nucleotide sequence encoding a polypeptide capable of catalyzing the glucosylation of stevioside or rebaudioside A, whereby expression of the nucleotide sequence confers on the microorganism the ability to produce at least rebaudioside D.

7. The process according to claim 1, wherein the recombinant microorganism comprises a nucleotide sequence encoding a polypeptide capable of catalyzing the glucosylation of stevioside, whereby expression of the nucleotide sequence confers on the microorganism the ability to produce at least rebaudioside E.

8. The process according to claim 1, wherein the recombinant microorganism comprises a nucleotide sequence encoding a polypeptide capable of catalyzing the glucosylation of rebaudioside E, whereby expression of the nucleotide sequence confers on the microorganism the ability to produce at least rebaudioside D.

9. The process according to claim 1, wherein the recombinant microorganism comprises a nucleotide sequence encoding a polypeptide capable of catalyzing the glucosylation of rebaudioside D, whereby expression of the nucleotide sequence confers on the microorganism the ability to produce at least rebaudioside M.

10. The process according to claim 1, wherein the recombinant microorganism expresses a nucleotide sequence encoding a polypeptide having NADPH-cytochrome p450 reductase activity.

11. The process according to claim 1, wherein the recombinant microorganism expresses one or more of:

a. a nucleotide sequence encoding a polypeptide having ent-copalyl pyrophosphate synthase activity, wherein said nucleotide sequence comprises:

i. a nucleotide sequence encoding a polypeptide having ent-copalyl pyrophosphate synthase activity, said polypeptide comprising an amino acid sequence that has at least about 70% sequence identity with the amino acid sequence of SEQ ID NOs: 2, 4, 6, 8, 18, 20, 60 or 62;

ii. a nucleotide sequence that has at least about 70% sequence identity with the nucleotide sequence of SEQ ID NOs: 141, 142, 151, 152, 153, 154, 159, 160, 182 or 184;
iii. a nucleotide sequence, the complementary strand of which will hybridizes to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code, b. a nucleotide sequence encoding a polypeptide having ent-Kaurene synthase activity, wherein said nucleotide sequence comprises:
i. a nucleotide sequence encoding a polypeptide having ent-Kaurene synthase activity, said polypeptide comprising an amino acid sequence that has at least about 70% sequence identity with the amino acid sequence of SEQ ID NOs: 10, 12, 14, 16, 18, 20, 64 or 66;
ii. a nucleotide sequence that has at least about 70% sequence identity with the nucleotide sequence of SEQ ID NOs: 143, 144, 155, 156, 157, 158, 159, 160, 183 or 184;
iii. a nucleotide sequence, the complementary strand of which will hybridizes to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code, c. a nucleotide sequence encoding a polypeptide having ent-Kaurene oxidase activity, wherein said nucleotide sequence comprises:
i. a nucleotide sequence encoding a polypeptide having ent-Kaurene oxidase activity, said polypeptide comprising an amino acid sequence that has at least about 70% sequence identity with the amino acid sequence of SEQ ID NOs: 22, 24, 26, 68 or 86;
ii. a nucleotide sequence that has at least about 70% sequence identity with the nucleotide sequence of SEQ ID NOs: 145, 161, 162, 163, 180 or 186;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code; or d. a nucleotide sequence encoding a polypeptide having kaurenoic acid 13-hydroxylase activity, wherein said nucleotide sequence comprises:
i. a nucleotide sequence encoding a polypeptide having kaurenoic acid 13-hydroxylase activity, said polypeptide comprising an amino acid sequence that has at least about 70% sequence identity with the amino acid sequence of SEQ ID NOs: 28, 30, 32, 34, 70, 90, 92, 94, 96 or 98;
ii. a nucleotide sequence that has at least about 70% sequence identity with the nucleotide sequence of SEQ ID NOs: 146, 164, 165, 166, 167 or 185;
iii. a nucleotide sequence, the complementary strand of which will hybridizes to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code.

12. The process according to claim 1, wherein the recombinant microorganism expresses a nucleotide sequence encoding a polypeptide capable of catalyzing the addition of a glucose at the C-13 position of steviol, wherein said nucleotide comprises:
i. a nucleotide sequence encoding a polypeptide capable of catalyzing the addition of a glucose at the C-13 position of steviol, said polypeptide comprising an amino acid sequence that has at least about 70% sequence identity with the amino acid sequence of SEQ ID NOs: 36, 38 or 72;
ii. a nucleotide sequence that has at least about 70% sequence identity with the nucleotide sequence of SEQ ID NOs: 147, 168, 169 or 189;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code.

13. The process according to claim 1, wherein the recombinant microorganism expresses a nucleotide sequence encoding a polypeptide capable of catalyzing the addition of a glucose at the C-13 position of steviolmonoside, wherein said nucleotide comprises:
i. a nucleotide sequence encoding a polypeptide capable of catalyzing the addition of a glucose at the C-13 position of steviolmonoside, said polypeptide comprising an amino acid sequence that has at least about 70% sequence identity with the amino acid sequence of SEQ ID NOs: 88, 100, 102, 104, 106, 108, 110, 112;
ii. a nucleotide sequence that has at least about 70% sequence identity with the nucleotide sequence of SEQ ID NOs: 181 or 192;
iii. a nucleotide sequence, the complementary strand of which will hybridizes to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code.

14. The process according to claim 1, wherein the recombinant microorganism expresses a nucleotide sequence encoding a polypeptide capable of catalyzing the addition of a glucose at the C-19 position of steviolbioside, wherein said nucleotide sequence comprises:
  i. a nucleotide sequence encoding a polypeptide capable of catalyzing the addition of a glucose at the C-19 position of steviolbioside, said polypeptide comprising an amino acid sequence that has at least about 70% sequence identity with the amino acid sequence of SEQ ID NOs: 40, 42, 44, 46, 48 or 74;
  ii. a nucleotide sequence that has at least about 70% sequence identity with the nucleotide sequence of SEQ ID NOs: 148, 170, 171, 172, 173, 174 or 190;
  iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
  iv. a nucleotide sequence which differs from the nucleotide sequence of (i), (ii) or (iii) due to the degeneracy of the genetic code.

15. The process according to claim 1, wherein the recombinant microorganism expresses a nucleotide sequence encoding a polypeptide capable of catalyzing glucosylation of the C-3' of the glucose at the C-13 position of stevioside, wherein said nucleotide sequence comprises:
  i. a nucleotide sequence encoding a polypeptide capable of catalyzing glucosylation of the C-3' of the glucose at the C-13 position of stevioside, said polypeptide comprising an amino acid sequence that has at least about 70% sequence identity with the amino acid sequence of SEQ ID NOs: 50, 52 or 76;
  ii. a nucleotide sequence that has at least about 70% sequence identity with the nucleotide sequence of SEQ ID NOs: 149, 175, 176 or 191;
  iii. a nucleotide sequence, the complementary strand of which will hybridizes to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
  iv. a nucleotide sequence which differs from the nucleotide sequence of (i), (ii) or (iii) due to the degeneracy of the genetic code.

16. The process according to claim 1, wherein the recombinant microorganism expresses a nucleotide sequence encoding a polypeptide capable of catalysing one or more of: the glucosylation of stevioside or rebaudioside A to rebaudioside D; the glucosylation of stevioside to rebaudioside E; the glucosylation of rebaudioside E to rebaudioside D; or the glucosylation of rebaudioside D to rebaudioside M, wherein said nucleotide sequence comprises:
  i. a nucleotide sequence encoding a polypeptide capable of catalysing one or more of: the glucosylation of stevioside or rebaudioside A to rebaudioside D; the glucosylation of stevioside to rebaudioside E; the glucosylation of rebaudioside E to rebaudioside D; or the glucosylation of rebaudioside D to rebaudioside M, said polypeptide comprising an amino acid sequence that has at least about 70% sequence identity with the amino acid sequence of SEQ ID NOs: 88, 100, 102, 104, 106, 108, 110, 112;
  ii. a nucleotide sequence that has at least about 70% sequence identity with the nucleotide sequence of SEQ ID NOs: 181 or 192;
  iii. a nucleotide sequence, the complementary strand of which will hybridizes to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
  iv. a nucleotide sequence which differs from the nucleotide sequence of (i), (ii) or (iii) due to the degeneracy of the genetic code.

17. The process according to claim 1, wherein the ability of the recombinant microorganism to produce geranylgeranyl diphosphate (GGPP) is upregulated.

18. The process according to claim 17, wherein the recombinant microorganism comprises one or more nucleotide sequence(s) encoding hydroxymethylglutaryl-CoA reductase, farnesyl-pyrophosphate synthetase and geranylgeranyl diphosphate synthase, whereby expression of the nucleotide sequence(s) confer(s) on the microorganism the ability to produce elevated levels of GGPP.

19. The process according to claim 17, wherein the recombinant microorganism expresses one or more of:
  a. a nucleotide sequence encoding a polypeptide having hydroxymethylglutaryl-CoA reductase activity, wherein said nucleotide sequence comprises:
    i. a nucleotide sequence encoding a polypeptide having hydroxymethylglutaryl-CoA reductase activity, said polypeptide comprising an amino acid sequence that has at least about 20% 70% sequence identity with the amino acid sequence of SEQ ID NO: 80;
    ii. a nucleotide sequence that has at least about 70% sequence identity with the nucleotide sequence of SEQ ID NO: 79;
    iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
    iv. a nucleotide sequence which differs from the nucleic sequence of (i), (ii) or (iii) due to the degeneracy of the genetic code,
  b. a nucleotide sequence encoding a polypeptide having farnesyl-pyrophosphate synthetase activity, wherein said nucleotide sequence comprises:
    i. a nucleotide sequence encoding a polypeptide having farnesyl-pyrophosphate synthetase activity, said polypeptide comprising an amino acid sequence that has at least about 70% sequence identity with the amino acid sequence of SEQ ID NO: 82;
    ii. a nucleotide sequence that has at least about 70% sequence identity with the nucleotide sequence of SEQ ID NOs: 81;
    iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C.

for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code; or
c. a nucleotide sequence encoding a polypeptide having geranylgeranyl diphosphate synthase activity, wherein said nucleotide sequence comprises:
i. a nucleotide sequence encoding a polypeptide having geranylgeranyl diphosphate synthase activity, said polypeptide comprising an amino acid sequence that has at least about 70% sequence identity with the amino acid sequence of SEQ ID NO: 84;
ii. a nucleotide sequence that has at least about 70% sequence identity with the nucleotide sequence of SEQ ID NOs: 83;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code.

20. The process according to claim 1, wherein fermentation is carried out at a temperature of at least 30° C., and below 45° C.

21. The process according to claim 20, wherein the microorganism is a *Yarrowia lipolytica* cell.

22. The process according to claim 1, wherein the process is carried out on an industrial scale.

23. A method for the production of a steviol glycoside, which method comprises:
fermenting a recombinant microorganism of the genus *Yarrowia* in a suitable fermentation medium at a temperature of about 29° C. or higher and below 45° C., wherein the temperature of fermentation in such method is from 32° C. to 34° C. during the steviol glycoside production phase,
wherein the microorganism comprises one or more nucleotide sequence(s) encoding:
a. a polypeptide having ent-copalyl pyrophosphate synthase activity, wherein said nucleotide sequence comprises:
i. a nucleotide sequence encoding a polypeptide having ent-copalyl pyrophosphate synthase activity, said polypeptide comprising an amino acid sequence that has at least about 70% sequence identity with the amino acid sequence of SEQ ID NOs: 2, 4, 6, 8, 18, 20, 60 or 62;
ii. a nucleotide sequence that has at least about 70% sequence identity with the nucleotide sequence of SEQ ID NOs: 141, 142, 151, 152, 153, 154, 159, 160, 182 or 184;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code;
b. a polypeptide having ent-Kaurene synthase activity, wherein said nucleotide sequence comprises:
i. a nucleotide sequence encoding a polypeptide having ent-Kaurene synthase activity, said polypeptide comprising an amino acid sequence that has at least about 70% sequence identity with the amino acid sequence of SEQ ID NOs: 10, 12, 14, 16, 18, 20, 64 or 66;
ii. a nucleotide sequence that has at least about 70% sequence identity with the nucleotide sequence of SEQ ID NOs: 143, 144, 155, 156, 157, 158, 159, 160, 183 or 184;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code;
c. a polypeptide having ent-Kaurene oxidase activity, wherein said nucleotide sequence comprises:
i. a nucleotide sequence encoding a polypeptide having ent-Kaurene oxidase activity, said polypeptide comprising an amino acid sequence that has at least about 70% sequence identity with the amino acid sequence of SEQ ID NOs: 22, 24, 26, 68 or 86;
ii. a nucleotide sequence that has at least about 70% sequence identity with the nucleotide sequence of SEQ ID NOs: 145, 161, 162, 163, 180 or 186;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or
iv. a nucleotide sequence which differs from the nucleotide sequence of (i), (ii) or (iii) due to the degeneracy of the genetic code; and
d. a polypeptide having kaurenoic acid 13-hydroxylase activity, wherein said nucleotide sequence comprises:
i. a nucleotide sequence encoding a polypeptide having kaurenoic acid 13-hydroxylase activity, said polypeptide comprising an amino acid sequence that has at least about 70% sequence identity with the amino acid sequence of SEQ ID NOs: 28, 30, 32, 34, 70, 90, 92, 94, 96 or 98;
ii. a nucleotide sequence that has at least about 70% sequence identity with the nucleotide sequence of SEQ ID NOs: 146, 164, 165, 166, 167 or 185;
iii. a nucleotide sequence, the complementary strand of which will hybridize to a nucleic acid molecule of sequence (i) or (ii), under stringent conditions, wherein said hybridization is conducted in a 1 M salt solution, for at least 10 hours, with washing at 65° C. for at least one hour, with at least two changes of the washing solution, wherein the washing solution comprises a 0.1 M salt solution; or iv. a nucleotide sequence which differs from the nucleotide sequence of (i), (ii) or (iii) due to the degeneracy of the genetic code;

whereby expression of the nucleotide sequence(s) confer(s) on the microorganism the ability to produce at least steviol, and wherein the recombinant microorganism further comprises a nucleotide sequence encoding a polypeptide capable of catalyzing the glucosylation of rebaudioside D, whereby expression of the nucleotide sequence confers on the microorganism the ability to produce at least rebaudioside M; and recovering the steviol glycoside.

* * * * *